United States Patent 11,466,259 (ENGINEERED GALACTOSE OXIDASE VARIANT ENZYMES) - sequence listing, part 2

SEQ ID NO: 1792 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1793 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacgaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1794 - protein, 650 aa, Artificial Sequence
  Variant of Galactose Ox
MASAPIGVAIPRNNWAVTCDSAQSGNECNEAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1795 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgctatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaggatcaaactggccaccatcaccatcaccattag

SEQ ID NO: 1796 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITAWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1797 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1798 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1799 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggtctgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1800 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWSDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1801 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctattccgggatactggatgttgttcgttatgaattccgctggtgtaccctccgttgcgtcgacgattaacgttacccagggccaaactggccaccatcaccatcaccattag

SEQ ID NO: 1802 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVAIPGYWMLFVMNSAGVPSVASTINVTQGQTGHHHHHH

SEQ ID NO: 1803 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttacttgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1804 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLLDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1805 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccggggcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1806 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAGAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1807 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgctgggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1808 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTLGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1809 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcacttgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1810 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAALEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1811 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggatcgggatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1812 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDRDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1813 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcaagttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1814 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIKLTLTNNGGNSYSFQVPSDSGVALPGYWMLFVMNSAGVPSVASTINVTQGQTGHHHHHH

SEQ ID NO: 1815 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggatcatgatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1816 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDHDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1817 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatttgaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1818 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSFDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1819 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtggttcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1820 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGGSYSFQVPSDSGVALPGYWMLFVMNSAGVPSVASTINVTQGQTGHHHHHH

SEQ ID NO: 1821 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcagcgttctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1822 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQRSSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1823 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgatggatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1824 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMMDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1825 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgtcgtggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1826 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMSWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1827 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggtgagcggggttgctcttccgggatactggatgttgttcgttatgaattccgctggtgtaccctccgttgcgtcgacgattaacgttacccagggccaaactggccaccatcaccatcaccattag

SEQ ID NO: 1828 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSVSGVALPGYWMLFVMNSAGVPSVASTINVTQGQTGHHHHHH

SEQ ID NO: 1829 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaagatgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1830 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKDVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1831 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcgtgaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1832 - protein, 650 aa, Artificial Sequence
  Variant of Galactose Ox
MASAPIGVAIPRNNWAVTCDSAQSGNECVKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1833 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcattggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1834 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSLDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1835 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaagtgtccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggggggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1836 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKVSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGGITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1837 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgctgatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1838 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSALMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1839 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacattaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1840 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNINSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1841 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgctttcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1842 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSLSAASLIRYGTATHTVNTDQRRIPLTLTNNGGNSYSFQVPSDSGVALPGYWMLFVMNSAGVPSVASTINVTQGQTGHHHHHH

SEQ ID NO: 1843 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcagaattctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1844 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQNSSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1845 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtctgttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1846 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRLLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1847 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgcttgacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1848 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISLDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1849 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaggggtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1850 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKGVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1851 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaacaggtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1852 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKQVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1853 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaagtaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1854 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLSNNGGNSYSFQVPSDSGVALPGYWMLFVMNSAGVPSVASTINVTQGQTGHHHHHH

SEQ ID NO: 1855 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacctgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1856 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNLNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1857 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggtttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1858 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1859 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgaatgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1860 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMNDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1861 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtctttcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1862 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGLSYSFQVPSDSGVALPGYWMLFVMNSAGVPSVASTINVTQGQTGHHHHHH

SEQ ID NO: 1863 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtaaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1864 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRKSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1865 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1866 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1867 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaaccgtgcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1868 - protein, 650 aa, Artificial Sequence
  Variant of Galactose Ox
MASAPIGVAIPRNNWAVTCDSAQSGNECNRAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1869 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggttgatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1870 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTVDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1871 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgaggcgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1872 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEASPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1873 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggttttttgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1874 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFFDSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1875 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatcagtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1876 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDQFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1877 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1878 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1879 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagtaccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1880 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1881 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgctggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1882 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISLDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1883 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtgttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtgactcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggtagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatttcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1884 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRDSNRGVAPDAMCGNAVMYDAVKGKILTFGGSPDYQDSDATTNAHIITLGEPGTSPNTVFASNGLLFARTFHTSVVLPDGSTFITGGQQRGIPTVDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1885 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaacaagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtgttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggtagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatttcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1886 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKQVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTVDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1887 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtgttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggtagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatttcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1888 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTVDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1889 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtgttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgctgtcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1890 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSLSAASLIRYGTATHTVNTDQRRIPLTLTNNGGNSYSFQVPSDSGVALPGYWMLFVMNSAGVPSVASTINVTQGQTGHHHHHH

SEQ ID NO: 1891 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaaccgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtgttgatgtggagctcttatcgtcaggatgcgtttgaggcttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggtagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgctgtcggccgcaagtttaattcgctacggaactgctactcacacggtgaacaccgatcagcgccgcatcccgttgacgttatcgaataacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1892 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEASPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTVDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSLSAASLIRYGTATHTVNTDQRRIPLTLSNNGGNSYSFQVPSDSGVALPGYWMLFVMNSAGVPSVASTINVTQGQTGHHHHHH

SEQ ID NO: 1893 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaagacgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggtagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatttcggccgcaagtttaattcgctacggaactgctactcacacggtgaacaccgatcagcgccgcatcccgttgacgttaacggcaaacggaggtaattcgtacagctttcaagttccgtcggatagcggggttgctcttccgggatactggatgttgttcgttatgaattccgctggtgtaccctccgttgcgtcgacgattaacgttacccagggccaaactggccaccatcaccatcaccattag

SEQ ID NO: 1894 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKDVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTVDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTANGGNSYSFQVPSDSGVALPGYWMLFVMNSAGVPSVASTINVTQGQTGHHHHHH

SEQ ID NO: 1895 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaagacgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggtagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatttcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1896 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKDVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTVDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1897 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgaatggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgctgtcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1898 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMNGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSLSAASLIRYGTATHTVNTDQRRIPLTLTNNGGNSYSFQVPSDSGVALPGYWMLFVMNSAGVPSVASTINVTQGQTGHHHHHH

SEQ ID NO: 1899 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaacaagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtgactcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggtagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1900 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKQVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRDSNRGVAPDAMCGNAVMYDAVKGKILTFGGSPDYQDSDATTNAHIITLGEPGTSPNTVFASNGLLFARTFHTSVVLPDGSTFITGGQQRGIPTVDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1901 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaaccgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgaggcttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcggatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggatagcggggttgctcttccgggatactggatgttgttcgttatgaattccgctggtgtaccctccgttgcgtcgacgattaacgttacccagggccaaactggccaccatcaccatcaccattag

SEQ ID NO: 1902 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEASPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1903 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaaccgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgctgtcggccgcaagtttaattcgctacggaactgctactcacacggtgaacaccgatcagcgccgcatcccgttgacgttaacggcaaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1904 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSLSAASLIRYGTATHTVNTDQRRIPLTLTANGGNSYSFQVPSDSGVALPGYWMLFVMNSAGVPSVASTINVTQGQTGHHHHHH

SEQ ID NO: 1905 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaaccgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtctgttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatttcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1906 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRLLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1907 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaacaagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtgttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggtagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatttcggccgcaagtttaattcgctacggaactgctactcacacggtgaacaccgatcagcgccgcatcccgttgacgttaacggcaaacggaggtaattcgtacagctttcaagttccgtcggatagcggggttgctcttccgggatactggatgttgttcgttatgaattccgctggtgtaccctccgttgcgtcgacgattaacgttacccagggccaaactggccaccatcaccatcaccattag

SEQ ID NO: 1908 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKQVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTVDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTANGGNSYSFQVPSDSGVALPGYWMLFVMNSAGVPSVASTINVTQGQTGHHHHHH

SEQ ID NO: 1909 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtgttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgctggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgaatggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatttcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1910 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISLDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMNGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1911 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1912 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1913 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcttctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggagcgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1914 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWSDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1915 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcgtcaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaattccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1916 - protein, 650 aa, Artificial Sequence
  Variant of Galactose Oxidase from Fusarium graminearum
MASAPIGVAIPRNNWAVTCDSAQSGNECVKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1917 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcttctagttacactgccccgcagccgggcttggggcgctggggcccgacaatcgatcttcccattgtgccatcggccgccgcactggagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatacgattcgagctcggactcttggattccgggcccggatatgcaggtcgcgcgtgggtataactcaagtgcgactatgaacgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggaccgacatgtcgatctcggccgcaagtttaattcgctacggaactgctactcacacggtgaacaccgatcagcgccgcatcccgttgatgttaacgaacaacggaggtctgtcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1918 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAALEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMNDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLMLTNNGGLSYSFQVPSDSGVALPGYWMLFVMNSAGVPSVASTINVTQGQTGHHHHHH

SEQ ID NO: 1919 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcttctagttacactgccccgcagccgggcttggggcgctggggcccgacaatcgatcttcccattgtgccatcggccgccgcactggagccaacgagcggtcgtgtcttgatgtggagctcttatcgtcaggatcagtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatacgattcgagctcggactcttggattccgggcccggatatgcaggtcgcgcgtgggtataactcaagtgcgactatgagcgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggagcgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1920 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAALEPTSGRVLMWSSYRQDQFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWSDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1921 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcttctagttacactgccccgcagccgggcttggggcgctggggcccgacaatcgatcttcccattgtgccatcggccgccgcactggagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatacgattcgagctcggactcttggattccgggcccggatatgcaggtcgcgcgtgggtataactcaagtgcgactatgagcgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggagcgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1922 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAALEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWSDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1923 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcactggagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatacgattcgagctcggactcttggattccgggcccggatatgcaggtcgcgcgtgggtataactcaagtgcgactatgagcgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggagcgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1924 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAALEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWSDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1925 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcactggagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccaaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1926 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAALEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1927 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcagaactctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggaccgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1928 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQNSSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1929 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcgtcaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcactggagccaacgagcggtcgtgtcttgatgtggagctcttatcgtcaggatgcgtttgaggggtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatacgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccaaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1930 - protein, 650 aa, Artificial Sequence
  Variant of Galactose Oxidase from Fusarium graminearum
MASAPIGVAIPRNNWAVTCDSAQSGNECVKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAALEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1931 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcgtcaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcactggagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatacgattcgagctcggactcttggattccgggcccggatatgcaggtcgcgcgtgggtataactcaagtgcgactatgagcgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggactgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaattccaacggaagatagcacacccgtatttactccagagatctacgttcccgaacaagatactttttacaaacaaaacccaaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggaccgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1932 - protein, 650 aa, Artificial Sequence
  Variant of Galactose Oxidase from Fusarium graminearum
MASAPIGVAIPRNNWAVTCDSAQSGNECVKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAALEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1933 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcgtcaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcttctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1934 - protein, 650 aa, Artificial Sequence
  Variant of Galactose Oxidase from Fusarium graminearum
MASAPIGVAIPRNNWAVTCDSAQSGNECVKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1935 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcttctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgaacgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggaccgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1936 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMNDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1937 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgaccttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctgaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1938 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPEITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1939 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaactgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcatctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaagtctccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgaccttcgggggctcgcccgattatcaagattcagatgcgactacaaatgcccatatcatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctctgccgggatactggatgttgttcgttatgaattccgctggtgtaccctccgttgcgtcgacgattaacgttacccagggccaaactggccaccatcaccatcaccattag

SEQ ID NO: 1940 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKVSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1941 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaactgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcagcgctctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctctgccgggatactggatgttgttcgttatgaattccgctggtgtaccctccgttgcgtcgacgattaacgttacccagggccaaactggccaccatcaccatcaccattag

SEQ ID NO: 1942 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQRSSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1943 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaactgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcatctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaagtctccttatatgattcgagctcggactcttggattccgggcccggatatgcaggtcgcgcgtgggtataactcaagtgcgacgatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttggtgttcgggggctcgcccgattatcaagattcagatgcgactacaaatgcccatatcatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctattccgggatactggatgttgttcgttatgaattccgctggtgtaccctccgttgcgtcgacgattaacgttacccagggccaaactggccaccatcaccatcaccattag

SEQ ID NO: 1944 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKVSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILVFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVAIPGYWMLFVMNSAGVPSVASTINVTQGQTGHHHHHH

SEQ ID NO: 1945 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaggggtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcatctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtattttgtattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctattccgggatactggatgttgttcgttatgaattccgctggtgtaccctccgttgcgtcgacgattaacgttacccagggccaaactggccaccatcaccatcaccattag

SEQ ID NO: 1946 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKGVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFCIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVAIPGYWMLFVMNSAGVPSVASTINVTQGQTGHHHHHH

SEQ ID NO: 1947 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaggggtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcatctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcattcgaccctagcactggaattgtatccgatcgcactagtaccgttaccgggcacgacatgttttgccccggtatctcgatggacgggaacggtcagatcgtggtcagcggtggtaatgatgcaaagaaaacgtccttatatgattcgagctcggactcttggattccgggcccggatatgcaggtcgcgcgtgggtataactcaagtgcgacgatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatctgatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctattccgggatactggatgttgttcgttatgaattccgctggtgtaccctccgttgcgtcgacgattaacgttacccagggccaaactggccaccatcaccatcaccattag

SEQ ID NO: 1948 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKGVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSFDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHLITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVAIPGYWMLFVMNSAGVPSVASTINVTQGQTGHHHHHH

SEQ ID NO: 1949 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaactgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcatctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacgtccttatatgattcgagctcggactcttggattccgggcccggatatgcaggtcgcgcgtgggtataactcaagtgcgacgatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgaccttcgggggctcgcccgattatcaagattcagatgcgactacaaatgcccatctgatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctattccgggatactggatgttgttcgttatgaattccgctggtgtaccctccgttgcgtcgacgattaacgttacccagggccaaactggccaccatcaccatcaccattag

SEQ ID NO: 1950 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHLITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVAIPGYWMLFVMNSAGVPSVASTINVTQGQTGHHHHHH

SEQ ID NO: 1951 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaactgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcagcgctctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcattcgaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatatcatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctattccgggatactggatgttgttcgttatgaattccgctggtgtaccctccgttgcgtcgacgattaacgttacccagggccaaactggccaccatcaccatcaccattag

SEQ ID NO: 1952 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQRSSYTAPQPGLGRWGPTIDLPIVPSAAAIEPTSGRVLMWSSYRQDAFEGSPGGITLTSSFDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVAIPGYWMLFVMNSAGVPSVASTINVTQGQTGHHHHHH

SEQ ID NO: 1953 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaactgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcatctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcattcgaccctagcactggaattgtatccgatcgcactagtaccgttaccgggcacgacatgttttgccccggtatctcgatggacgggaacggtcagatcgtggtcagcggtggtaatgatgcaaagaaagtctccttatatgattcgagctcgaactcttggattccgggcccggatatgcaggtcgcgcgtgggtataactcaagtgcgctgatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgaccttcgggggctcgcccgattatcaagattcagatgcgactacaaatgcccatatcatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctctgccgggatactggatgttgttcgttatgaattccgctggtgtaccctccgttgcgtcgacgattaacgttacccagggccaaactggccaccatcaccatcaccattag

SEQ ID NO: 1954 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSFDPSTGIVSDRTSTVTGHDMFCPGISMDGNGQIVVSGGNDAKKVSLYDSSSNSWIPGPDMQVARGYNSSALMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1955 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaactgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcatctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacgtccttatatgattcgagctcggactcttggattccgggcccggatatgcaggtcgcgcgtgggtataactcaagtgcgctgatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctctgccgggatactggatgttgttcgttatgaattccgctggtgtaccctccgttgcgtcgacgattaacgttacccagggccaaactggccaccatcaccatcaccattag

SEQ ID NO: 1956 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSALMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1957 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttggtgttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctattccgggatactggatgttgttcgttatgaattccgctggtgtaccctccgttgcgtcgacgattaacgttacccagggccaaactggccaccatcaccatcaccattag

SEQ ID NO: 1958 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILVFGGSPDYQDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVAIPGYWMLFVMNSAGVPSVASTINVTQGQTGHHHHHH

SEQ ID NO: 1959 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaactgtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcatctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaagtctccttatatgattcgagctcggactcttggattccgggcccggatatgcaggtcgcgcgtgggtataactcaagtgcgacgatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgaccttcgggggctcgcccgattatcaagattcagatgcgactacaaatgcccatatcatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1960 - protein, 650 aa, Artificial Sequence; identical to SEQ ID NO: 1940
  Variant of Galactose Oxidase from Fusarium graminearum

SEQ ID NO: 1961 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcgtcaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcagaactctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtctgtcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1962 - protein, 650 aa, Artificial Sequence
  Variant of Galactose Oxidase from Fusarium graminearum
MASAPIGVAIPRNNWAVTCDSAQSGNECVKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQNSSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGLSYSFQVPSDSGVALPGYWMLFVMNSAGVPSVASTINVTQGQTGHHHHHH

SEQ ID NO: 1963 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatacgaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1964 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDTKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1965 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactggttatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1966 - protein, 650 aa, Artificial Sequence
  Variant of Galactose Oxidase from Fusarium graminearum
MASAPIGVAIPRNNWAVTCDSAQSGNECNKAIDGNKDTFWHTGYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1967 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactacgtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1968 - protein, 650 aa, Artificial Sequence
  Variant of Galactose Oxidase from Fusarium graminearum
MASAPIGVAIPRNNWAVTCDSAQSGNECNKAIDGNKDTFWHTTYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1969 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagttgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1970 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFELSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1971 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacattcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1972 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYIQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1973 - DNA, 1953 bp, Artificial Sequence
  Variant of Galactose Oxidase from Fusarium graminearum
atggcaaaggcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1974 - protein, 650 aa, Artificial Sequence
  Variant of Galactose Oxidase from Fusarium graminearum
MAKAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1975 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcactttcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1976 - protein, 650 aa, Artificial Sequence
  Variant of Galactose Oxidase from Fusarium graminearum
MASAPIGVAIPRNNWAVTCDSAQSGNECNKAIDGNKDTFWHFQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1977 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgtttccgcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1978 - protein, 650 aa, Artificial Sequence
  Variant of Galactose Oxidase from Fusarium graminearum
MASAPIGVAIPRNNWAVTCDSAQSGNECNKAIDGNKDTFPHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1979 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatgtgaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1980 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDVKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1981 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataatgcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1982 - protein, 650 aa, Artificial Sequence
  Variant of Galactose Oxidase from Fusarium graminearum
MASAPIGVAIPRNNWAVTCDSAQSGNECNNAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1983 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactgattatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1984 - protein, 650 aa, Artificial Sequence
  Variant of Galactose Oxidase from Fusarium graminearum
MASAPIGVAIPRNNWAVTCDSAQSGNECNKAIDGNKDTFWHTDYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1985 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattcatgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1986 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIHEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1987 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacccgcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1988 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYPQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1989 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacatgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1990 - protein, 650 aa, Artificial Sequence
  Variant of Galactose Oxidase from Fusarium graminearum
MASAPIGVAIPRNNWAVTCDSAQSGNECNKAIDGNKDMFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1991 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaatttgtgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1992 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSICEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1993 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgacgccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1994 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPTPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1995 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaacatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1996 - protein, 650 aa, Artificial Sequence
  Variant of Galactose Oxidase from Fusarium graminearum
MASAPIGVAIPRNNWAVTCDSAQSGNECNKAIDGNKDTFWHTQHGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1997 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatattaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1998 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDIKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 1999 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2000 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPLPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2001 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttgggggtgtggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2002 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGVWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2003 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcataaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2004 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDHKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2005 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttaccttcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2006 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYLQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2007 - DNA, 1953 bp, Artificial Sequence
  Variant of Galactose Oxidase from Fusarium graminearum
atggcatcagcaccgatcggggtacttatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2008 - protein, 650 aa, Artificial Sequence
  Variant of Galactose Oxidase from Fusarium graminearum
MASAPIGVLIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2009 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggactgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2010 - protein, 650 aa, Artificial Sequence
  Variant of Galactose Oxidase from Fusarium graminearum
MASAPIGVAIPRNNWAVTCDSAQSGTECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2011 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacgtgcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2012 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYVQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2013 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgttgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2014 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIVEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2015 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttaccgtcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2016 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYRQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2017 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatccgaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2018 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNPNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2019 - DNA, 1953 bp, Artificial Sequence
  Variant of Galactose Oxidase from Fusarium graminearum
atggcatcagcaccgatcggggtagccatcccgcgcaacaactgggccgtttcgtgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2020 - protein, 650 aa, Artificial Sequence
  Variant of Galactose Oxidase from Fusarium graminearum
MASAPIGVAIPRNNWAVSCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2021 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaatttctgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2022 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSISEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2023 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtctgtcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2024 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGLSYSFQVPSDSGVALPGYWMLFVMNSAGVPSVASTINVTQGQTGHHHHHH

SEQ ID NO: 2025 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcagtggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2026 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGQWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2027 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcactaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2028 - protein, 650 aa, Artificial Sequence
  Variant of Galactose Oxidase from Fusarium graminearum
MASAPIGVAIPRNNWAVTCDSAQSGNECTKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2029 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcggggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2030 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGGGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2031 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtaatgatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2032 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRNDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2033 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgatcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2034 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANDQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2035 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcatgaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2036 - protein, 650 aa, Artificial Sequence
  Variant of Galactose Oxidase from Fusarium graminearum
MASAPIGVAIPRNNWAVTCDSAQSGNECMKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2037 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2038 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2039 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaatttggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2040 - protein, 650 aa, Artificial Sequence
  Variant of Galactose Oxidase from Fusarium graminearum
MASAPIGVAIPRNNWAVTCDSAQSGNECNLAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2041 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcgttaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2042 - protein, 650 aa, Artificial Sequence
  Variant of Galactose Oxidase from Fusarium graminearum
MASAPIGVAIPRNNWAVTCDSAQSGNECVKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2043 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcagtgggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2044 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGSGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2045 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatgataaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2046 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDDKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2047 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggcgccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2048 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGAPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2049 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaaccctgatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2050 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNPDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2051 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattggtgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2052 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIGEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2053 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacgctcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2054 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYAQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2055 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcgcgaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2056 - protein, 650 aa, Artificial Sequence
  Variant of Galactose Oxidase from Fusarium graminearum
MASAPIGVAIPRNNWAVTCDSAQSGNECAKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2057 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaatcgtgcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2058 - protein, 650 aa, Artificial Sequence
  Variant of Galactose Oxidase from Fusarium graminearum
MASAPIGVAIPRNNWAVTCDSAQSGNECNRAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2059 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2060 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2061 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactccttatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2062 - protein, 650 aa, Artificial Sequence
  Variant of Galactose Oxidase from Fusarium graminearum
MASAPIGVAIPRNNWAVTCDSAQSGNECNKAIDGNKDTFWHTPYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2063 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgctataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2064 - protein, 650 aa, Artificial Sequence
  Variant of Galactose Oxidase from Fusarium graminearum
MASAPIGVAIPRNNWAVTCDSAQSGNECYKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2065 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggcatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2066 - protein, 650 aa, Artificial Sequence
  Variant of Galactose Oxidase from Fusarium graminearum
MASAPIGVAIPRNNWAVTCDSAQSGHECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2067 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggtgtgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2068 - protein, 650 aa, Artificial Sequence
  Variant of Galactose Oxidase from Fusarium graminearum
MASAPIGVAIPRNNWAVTCDSAQSGCECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2069 - DNA, 1953 bp, Artificial Sequence
  Variant of Galactose Oxidase from Fusarium graminearum
atggcatcaaagccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2070 - protein, 650 aa, Artificial Sequence
  Variant of Galactose Oxidase from Fusarium graminearum
MASKPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2071 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcaaggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2072 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGKGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2073 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaactgtgatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2074 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNCDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2075 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaattcgaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2076 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNSNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2077 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatgcgaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2078 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNANGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2079 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2080 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2081 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactctgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2082 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATLSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2083 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactctgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtactttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacaatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2084 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATLSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYNSDGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2085 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2086 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2087 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatgttgtatttgcgagtaatgggttactgttcgctcgtacctttcatacctcggtggtccttccggacgggagtaccttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2088 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNVVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2089 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtactttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2090 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSDGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2091 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacaatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2092 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYNSDGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2093 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaaccgcggagtagccccagacgccatgtgcggtaatgccgtaatgtacgacgcagtcaaaggcaaaattttgactttcgggggctcgcccgattatcaagattcagatgcgactacaaatgcccatattatcacgattggcgagcctggcacgagtccgaatacggtatttgcgagtaatgggttactgttcgctcgtacctttcatacctcggtggtccttccggacgggagtaccttcatcacaggaggccagcagcgcggagttccactggaagatagcacacccgtatttactccagagatctacgttcccgaaaccgatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2094 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITIGEPGTSPNTVFASNGLLFARTFHTSVVLPDGSTFITGGQQRGVPLEDSTPVFTPEIYVPETDTFYKQNPNSIVRAYHSISLLLPDGRVFNGGGGLCGDCETNHFDAQIFTPNYLYDSDGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2095 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactctgagtgatgggcgcgtatttacgattggcggcagtttttccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgattggcgagcctggcacgagtccgaatgttgtatttgcgagtaatgggttactgttcgctcgtacctttcatacctcggtggtccttccggacgggagtgtattcatcacaggaggccagcagcgcggagttccactggaagatagcacacccgtactgactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2096 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATLSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITIGEPGTSPNVVFASNGLLFARTFHTSVVLPDGSVFITGGQQRGVPLEDSTPVLTPEIYVPEQDTFYKQNPNSIVRAYHSISLLLPDGRVFNGGGGLCGDCETNHFDAQIFTPNYLYDSDGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2097 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2098 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2099 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtactttcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2100 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSTFITGGQQRGVPGEDSTPVFTPEIYVPEQDTFYKQNPNSIVRAYHSISLLLPDGRVFNGGGGLCGDCETNHFDAQIFTPNYLYDSDGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2101 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2102 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSTFITGGQQRGVPGEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2103 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaatgtgaatggcctttctgtactgccacgtcaggatggcaatcaaaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacagccaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2104 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYSQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2105 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaatgcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatagtaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2106 - protein, 650 aa, Artificial Sequence
  Variant of Galactose Oxidase from Fusarium graminearum
MASAPIGVAIPRNNWAVTCDSAQSGNECINAIDGNKDTFWHTQYGVNGDPKPPHTITIDMKTVQNVNGLSVLPRQDGNSNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2107 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcctaaaccgccgcacaccatcacgatcgatatgaaaacagtacaaaatgtgaatggcctttctgtactgccacgtcaggatggcaatcaaaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2108 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2109 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatagtaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2110 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNSNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2111 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaatgcaattgacggtaataaagacacgttttggcacactcaatatggtgtaaacggagatgtaaaaccgccgcacaccatcacgatcgatatgaaaacagtacaaaatgtgaatggcctttctgtactgccacgtcaggatggcaatagtaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2112 - protein, 650 aa, Artificial Sequence
  Variant of Galactose Oxidase from Fusarium graminearum
MASAPIGVAIPRNNWAVTCDSAQSGNECSNAIDGNKDTFWHTQYGVNGDVKPPHTITIDMKTVQNVNGLSVLPRQDGNSNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2113 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaagcggtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2114 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQAVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2115 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcgcccgtgcaattgacggtaataaagacacgttttggcacactcaatatggtgtaaacggagatgtaaaaccgccgcacaccatcacgatcgatatgaaaacagtacaaaacgtgaatggcctttctgtactgccacgtcaggatggcaatagtaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2116 - protein, 650 aa, Artificial Sequence
  Variant of Galactose Oxidase from Fusarium graminearum
MASAPIGVAIPRNNWAVTCDSAQSGNECARAIDGNKDTFWHTQYGVNGDVKPPHTITIDMKTVQNVNGLSVLPRQDGNSNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2117 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttttccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgattggcgagcctggcacgagtccgaatacggtatttgcgagtaatgggttactgttcgctcgtacctttcatacctcggtggtccttccggacgggagtaccttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2118 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITIGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2119 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatagtaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgtgcccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2120 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNSNGWIGRHEVYLSSDGVNWGSPVASGSWFADSTTKYSNFETRPARYVRLVAITEANGQPWTSIAEINVFQASSYTAPCPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2121 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaatgcaattgacggtaataaagacacgttttggcacactcaatatggtgtaaacggagatcctaaaccgccgcacaccatcacgatcgatatgaaaacagtacaaaatgtgaatggcctttctgtactgccacgtcaggatggcaatagtaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2122 - protein, 650 aa, Artificial Sequence
  Variant of Galactose Oxidase from Fusarium graminearum
MASAPIGVAIPRNNWAVTCDSAQSGNECINAIDGNKDTFWHTQYGVNGDPKPPHTITIDMKTVQNVNGLSVLPRQDGNSNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2123 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtcgtgcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcaaaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacagccaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2124 - protein, 650 aa, Artificial Sequence
  Variant of Galactose Oxidase from Fusarium graminearum
MASAPIGVAIPRNNWAVTCDSAQSGNECSRAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYSQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2125 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattcgtgcaattgacggtaataaagacacgttttggcacactcaatatggtgtaaacggagatcccaaaccgccgcacaccatcacgatcgatatgaaaacagtacaaaatgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggcggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2126 - protein, 650 aa, Artificial Sequence
  Variant of Galactose Oxidase from Fusarium graminearum
MASAPIGVAIPRNNWAVTCDSAQSGNECIRAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2127 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactctgagtgatgggcgcgtatttacgattggcggcagtttttccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2128 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATLSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2129 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactctgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacaatagcaatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2130 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATLSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYNSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2131 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttttccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2132 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPGEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2133 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttttccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaaccgcggagtagccccagacgccatgtgcggtaatgccgtaatgtacgacgcagtcaaaggcaaaattttgactttcgggggctcgcccgattatcaagattcagatgcgactacaaatgcccatattatcacgattggcgagcctggcacgagtccgaatacggtatttgcgagtaatgggatgctgttcgctcgtacctttcatacctcggtggtccttccggacgggagtactttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2134 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITIGEPGTSPNTVFASNGMLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2135 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtcgtgcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatagtaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2136 - protein, 650 aa, Artificial Sequence
  Variant of Galactose Oxidase from Fusarium graminearum
MASAPIGVAIPRNNWAVTCDSAQSGNECSRAIDGNKDTFWHTQYGVNGDPKPPHTITIDMKTVQNVNGLSVLPRQDGNSNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2137 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccaggggaagatagcacacccgtatttactccagagatctactttcccgaaaccgatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2138 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSVFITGGQQRGVPGEDSTPVFTPEIYFPETDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2139 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcctaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2140 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2141 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatgtaaaaccgccgcacaccatcacgatcgatatgaaaacagtacaaaatgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacagccaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2142 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDVKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYSQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2143 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgattggcgagcctggcacgagtccgaatacggtatttgcgagtaatgggttactgttcgctcgtacctttcatacctcggtggtccttccggacgggagtaccttcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2144 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITIGEPGTSPNTVFASNGLLFARTFHTSVVLPDGSTFITGGQQRGVPGEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2145 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcctaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2146 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2147 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtcgtgcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcaaaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2148 - protein, 650 aa, Artificial Sequence
  Variant of Galactose Oxidase from Fusarium graminearum
MASAPIGVAIPRNNWAVTCDSAQSGNECSRAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2149 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataatgcaattgacggtaataaagacacgttttggcacactcaatatggtgtaaacggagatactaaaccgccgcacaccatcacgatcgatatgaaaacagtacaaaatgtgaatggcctttctgtactgccacgtcaggatggcaatagtaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgtgcccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2150 - protein, 650 aa, Artificial Sequence
  Variant of Galactose Oxidase from Fusarium graminearum
MASAPIGVAIPRNNWAVTCDSAQSGNECNNAIDGNKDTFWHTQYGVNGDTKPPHTITIDMKTVQNVNGLSVLPRQDGNSNGWIGRHEVYLSSDGVNWGSPVASGSWFADSTTKYSNFETRPARYVRLVAITEANGGPWTSIAEINVFQASSYTAPCPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2151 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcgccaatgcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatgaaaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgtgcccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2152 - protein, 650 aa, Artificial Sequence
  Variant of Galactose Oxidase from Fusarium graminearum
MASAPIGVAIPRNNWAVTCDSAQSGNECANAIDGNKDTFWHTQYGVNGDPKPPHTITIDMKTVQNVNGLSVLPRQDGNENGWIGRHEVYLSSDGVNWGSPVASGSWFADSTTKYSNFETRPARYVRLVAITEANGGPWTSIAEINVFQASSYTAPCPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2153 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2154 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSVFITGGQQRGVPGEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2155 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgattggcgagcctggcacgagtccgaatacgatatttgcgagtaatgggttactgttcgctcgtacctttcatacctcggtggtccttccggacgggagtaccttcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2156 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITIGEPGTSPNTIFASNGLLFARTFHTSVVLPDGSTFITGGQQRGVPGEDSTPVFTPEIYVPEQDTFYKQNPNSIVRAYHSISLLLPDGRVFNGGGGLCGDCETNHFDAQIFTPNYLYDSDGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2157 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttttccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2158 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2159 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactctgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgattggcgagcctggcacgagtccgaatgttgtatttgcgagtaatgggatgctgttcgctcgtacctttcatacctcggtggtccttccggacgggagtgtattcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2160 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATLSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITIGEPGTSPNVVFASNGMLFARTFHTSVVLPDGSVFITGGQQRGVPGEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2161 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2162 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2163 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggggtccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2164 - protein, 650 aa, Artificial Sequence; identical to SEQ ID NO: 2060
  Variant of Galactose Oxidase from Fusarium graminearum

SEQ ID NO: 2165 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaatcgggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2166 - protein, 650 aa, Artificial Sequence; identical to SEQ ID NO: 2058
  Variant of Galactose Oxidase from Fusarium graminearum

SEQ ID NO: 2167 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatgtaaaaccgccgcacaccatcacgatcgatatgaaaacagtacaaaacgtgaatggcctttctgtactgccacgtcaggatggcaatcaaaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacatccaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2168 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDVKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYIQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2169 - DNA, 1953 bp, Artificial Sequence; identical to SEQ ID NO: 2027
  Variant of Galactose Oxidase from Fusarium graminearum

SEQ ID NO: 2170 - protein, 650 aa, Artificial Sequence; identical to SEQ ID NO: 2028
  Variant of Galactose Oxidase from Fusarium graminearum

SEQ ID NO: 2171 - DNA, 1953 bp, Artificial Sequence; identical to SEQ ID NO: 2055
  Variant of Galactose Oxidase from Fusarium graminearum

SEQ ID NO: 2172 - protein, 650 aa, Artificial Sequence; identical to SEQ ID NO: 2056
  Variant of Galactose Oxidase from Fusarium graminearum

SEQ ID NO: 2173 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactgattatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2174 - protein, 650 aa, Artificial Sequence
  Variant of Galactose Oxidase from Fusarium graminearum
MASAPIGVAIPRNNWAVTCDSAQSGNECNKAIDGNKDTFWHTDYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2175 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatgttgtatttgcgagtaatgggttactgttcgctcgtacctttcatacctcggtggtccttccggacgggagtgtattcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2176 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNVVFASNGLLFARTFHTSVVLPDGSVFITGGQQRGVPGEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2177 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtcgtgcaattgacggtaataaagacacgttttggcacactcaatatggtgtaaacggagatcccaaaccgccgcacaccatcacgatcgatatgaaaacagtacaaaatgtgaatggcctttctgtactgccacgtcaggatggcaatcaaaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgatgattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2178 - protein, 650 aa, Artificial Sequence
  Variant of Galactose Oxidase from Fusarium graminearum
MASAPIGVAIPRNNWAVTCDSAQSGNECSRAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYDDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2179 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgctcgaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2180 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2181 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactctgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtactttcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2182 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATLSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPGEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2183 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattgggggtcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttactcgcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2184 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYSQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2185 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacagccaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2186 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYSQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2187 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactctgagtgatgggcgcgtatttacgattggcggcagtttttccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgattggcgagcctggcacgagtccgaatacggtatttgcgagtaatgggttactgttcgctcgtacctttcatacctcggtggtccttccggacgggagtactttcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2188 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATLSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITIGEPGTSPNTVFASNGLLFARTFHTSVVLPDGSTFITGGQQRGVPGEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2189 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatgttgtatttgcgagtaatgggttactgttcgctcgtacctttcatacctcggtggtccttccggacgggagtaccttcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2190 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNVVFASNGLLFARTFHTSVVLPDGSTFITGGQQRGVPGEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2191 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcgtatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtactttcatcacaggaggccagcagcgcggagttccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacaatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2192 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPGEDSTPVFTPEIYVPEQDTFYKQNPNSIVRAYHSISLLLPDGRVFNGGGGLCGDCETNHFDAQIFTPNYLYNSDGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2193 - DNA, 1953 bp, Artificial Sequence; identical to SEQ ID NO: 2163
  Variant of Galactose Oxidase from Fusarium graminearum

SEQ ID NO: 2194 - protein, 650 aa, Artificial Sequence; identical to SEQ ID NO: 2060
  Variant of Galactose Oxidase from Fusarium graminearum

SEQ ID NO: 2195 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtcgtgcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatagtaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2196 - protein, 650 aa, Artificial Sequence
  Variant of Galactose Oxidase from Fusarium graminearum
MASAPIGVAIPRNNWAVTCDSAQSGNECSRAIDGNKDTFWHTQYGVNGDPKPPHTITIDMKTVQNVNGLSVLPRQDGNSNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2197 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacatccaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2198 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYIQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2199 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacaagcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcggcttgacgttaacgaacaacggaggtaattcgtacagctttcaagttccgtcggacagcggggttgctatcccgggatactggatgttgttcgttatgaattccgctggtgtaccctccgttgcgtcgacgattaacgttacccagggccaaactggccaccatcaccatcaccattag

SEQ ID NO: 2200 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVAIPGYWMLFVMNSAGVPSVASTINVTQGQTGHHHHHH

SEQ ID NO: 2201 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgatgccgggcttgggggcctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggagttccaacggaagatagcacacccgtatttactccagagatctacgttcccgaacaagatactttttacgcgcaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctctgccgggatactggatgttgttcgttatgaattccgctggtgtaccctccgttgcgtcgacgattaacgttacccagggccaaactggccaccatcaccatcaccattag

SEQ ID NO: 2202 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPMPGLGAWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLLFARTFHTSVVLPDGSTFITGGQQRGVPTEDSTPVFTPEIYVPEQDTFYAQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2203 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtactgggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2204 - protein, 650 aa, Artificial Sequence
  Variant of Galactose Oxidase from Fusarium graminearum
MASAPIGVAIPRNNWAVTCDSAQSGNECNKAIDGNKDTFWHTQYGVLGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2205 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccggggataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2206 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTGDKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2207 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttaaggttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2208 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLRFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2209 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggactggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2210 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGLVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2211 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagcttcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2212 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQASDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2213 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattgggctggtgtaccctccgttgcgtcgacgattaacgttacccagggccaaactggccaccatcaccatcaccattag

SEQ ID NO: 2214 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNWAGVPSVASTINVTQGQTGHHHHHH

SEQ ID NO: 2215 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagcagcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2216 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFEQRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2217 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccttgcaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2218 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPLQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2219 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacactggcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2220 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTLAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2221 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacacgggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2222 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNTGGNSYSFQVPSDSGVALPGYWMLFVMNSAGVPSVASTINVTQGQTGHHHHHH

SEQ ID NO: 2223 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtggggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2224 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRGARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2225 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggggtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2226 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2227 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2228 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEMSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2229 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagctttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2230 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFELSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2231 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcggtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2232 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2233 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggagtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2234 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEESPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2235 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggagataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2236 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGDNSYSFQVPSDSGVALPGYWMLFVMNSAGVPSVASTINVTQGQTGHHHHHH

SEQ ID NO: 2237 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2238 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2239 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggccttcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2240 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGLQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2241 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtctcggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2242 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVSVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2243 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcggggcatgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2244 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGHVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2245 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcattctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2246 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEHSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2247 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactcagaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2248 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTQTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2249 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatacttttcttaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2250 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFLKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2251 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagggggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2252 - protein, 650 aa, Artificial Sequence
  Variant of Galactose Oxidase from Fusarium graminearum
MASAPIGVAIPRNNWAVTCDSAQRGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2253 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcagtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2254 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEQSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2255 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatgggcggaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2256 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGRNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2257 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagccagtgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2258 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSQWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2259 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtttgacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2260 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCLTNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2261 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtagatggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2262 - protein, 650 aa, Artificial Sequence
  Variant of Galactose Oxidase from Fusarium graminearum
MASAPIGVAIPRNNWAVTCDSAQSGNECNKAIDGNKDTFWHTQYGVDGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2263 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagtggtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2264 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEWSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2265 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2266 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2267 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcgtgagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2268 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2269 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaataaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2270 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDANKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2271 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacaacgcaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2272 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2273 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactcgtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2274 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTRTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2275 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcaagcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2276 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGKQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2277 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttaaatttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2278 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLNFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2279 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagaggtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2280 - protein, 650 aa, Artificial Sequence; identical to SEQ ID NO: 2232
  Variant of Galactose Oxidase from Fusarium graminearum

SEQ ID NO: 2281 - DNA, 1953 bp, Artificial Sequence; identical to SEQ ID NO: 2245
  Variant of Galactose Oxidase from Fusarium graminearum

SEQ ID NO: 2282 - protein, 650 aa, Artificial Sequence; identical to SEQ ID NO: 2246
  Variant of Galactose Oxidase from Fusarium graminearum

SEQ ID NO: 2283 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggagaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2284 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWRKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2285 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtacgttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2286 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2287 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggctgctgttcgctcgtacctttcatacctcggtggtccttccggacgggagtacgttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2288 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2289 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggctgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccatagg

SEQ ID NO: 2290 - protein, 651 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHHR

SEQ ID NO: 2291 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggctgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2292 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2293 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgaacctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2294 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2295 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtacgttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2296 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2297 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtactgactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2298 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVLTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2299 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2300 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2301 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtacgttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2302 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2303 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2304 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2305 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2306 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2307 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggctgctgttcgctcgtacctttcatacctcggtggtccttccggacgggagtacgttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2308 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2309 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2310 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2311 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2312 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2313 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggtttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2314 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2315 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtatttgacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2316 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYLTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2317 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtacgttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2318 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2319 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagctgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2320 - protein, 650 aa, Artificial Sequence; identical to SEQ ID NO: 2230
  Variant of Galactose Oxidase from Fusarium graminearum

SEQ ID NO: 2321 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2322 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2323 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgaggttaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2324 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEVNVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2325 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2326 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2327 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtacgttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2328 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2329 - DNA, 1953 bp, Artificial Sequence; identical to SEQ ID NO: 2227
  Variant of Galactose Oxidase from Fusarium graminearum

SEQ ID NO: 2330 - protein, 650 aa, Artificial Sequence; identical to SEQ ID NO: 2228
  Variant of Galactose Oxidase from Fusarium graminearum

SEQ ID NO: 2331 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggctgctgttcgctcgtacctttcatacctcggtggtccttccggacgggagtacgttcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2332 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSTFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2333 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggctgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2334 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2335 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactgggtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2336 - protein, 650 aa, Artificial Sequence
  Variant of Galactose Oxidase from Fusarium graminearum
MASAPIGVAIPRNNWAVTCDSAQSGNECNKAIDGNKDTFWHTGYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2337 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgttatacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2338 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCYTNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2339 - DNA, 1953 bp, Artificial Sequence
  Variant of Galactose Oxidase from Fusarium graminearum
atggcatcagcaccgatcggggtagccatcccgcgcaacacgtgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccatgaccgaagccaatgggcaaccgtggacttcaattgccgagattaacgtatttcaggcgtctagttatactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgcaatcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtactgactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2340 - protein, 650 aa, Artificial Sequence
  Variant of Galactose Oxidase from Fusarium graminearum
MASAPIGVAIPRNTWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAMTEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSQSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVLTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2341 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatacttttcggaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2342 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFRKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2343 - DNA, 1953 bp, Artificial Sequence; identical to SEQ ID NO: 2269
  Variant of Galactose Oxidase from Fusarium graminearum

SEQ ID NO: 2344 - protein, 650 aa, Artificial Sequence; identical to SEQ ID NO: 2270
  Variant of Galactose Oxidase from Fusarium graminearum

SEQ ID NO: 2345 - DNA, 1953 bp, Artificial Sequence
  Variant of Galactose Oxidase from Fusarium graminearum
atggcatcagcaccgatcggggtagccatcccgcgcaacacgtgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgcaatcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggtgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggggattgtgagacgaaccactttgatgcgcaaatctttacgccgaattatctttacgatagcaacgggaacttagccactcgccctaaaatcacccgtacctcaacccagtcagtcgtggttggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2346 - protein, 650 aa, Artificial Sequence
  Variant of Galactose Oxidase from Fusarium graminearum
MASAPIGVAIPRNTWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSQSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2347 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtacgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2348 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRTYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2349 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2350 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2351 - DNA, 1953 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcggcgtcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2352 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSASDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2353 - DNA, 1953 bp, Artificial Sequence; identical to SEQ ID NO: 2263
  Variant of Galactose Oxidase from Fusarium graminearum

SEQ ID NO: 2354 - protein, 650 aa, Artificial Sequence; identical to SEQ ID NO: 2264
  Variant of Galactose Oxidase from Fusarium graminearum

SEQ ID NO: 2355 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtactgactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2356 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVLTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2357 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatccatttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2358 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIHLTLTNNGGNSYSFQVPSDSGVALPGYWMLFVMNSAGVPSVASTINVTQGQTGHHHHHH

SEQ ID NO: 2359 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggctgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2360 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2361 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttacggttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2362 - protein, 650 aa, Artificial Sequence; identical to SEQ ID NO: 2208
  Variant of Galactose Oxidase from Fusarium graminearum

SEQ ID NO: 2363 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcagtaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggctgctgttcgctcgtacctttcatacctcggtggtccttccggacgggagtgtattcatcacaggaggccagcagcgcggagttccactggaagatagcacacccgtactgactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2364 - protein, 650 aa, Artificial Sequence
  Variant of Galactose Oxidase from Fusarium graminearum
MASAPIGVAIPRNNWAVTCDSAQSGNECSKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVLTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2365 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2366 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2367 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagcaggggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2368 - protein, 650 aa, Artificial Sequence
  Variant of Galactose Oxidase from Fusarium graminearum
MASAPIGVAIPRNNWAVTCDSAQQGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2369 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttagggttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2370 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLGFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2371 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2372 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2373 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttatatttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2374 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLYFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2375 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagagcaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2376 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTEQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2377 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgactcttcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2378 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDSSISAASLIRYGTATHTVNTDQRRIGLTLTNNGGNSYSFQVPSDSGVALPGYWMLFVMNSAGVPSVASTINVTQGQTGHHHHHH

SEQ ID NO: 2379 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2380 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2381 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggatgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2382 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGMLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2383 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttacgaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2384 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVTKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2385 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggattatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2386 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGIITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2387 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggggggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2388 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGGITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2389 - DNA, 1953 bp, Artificial Sequence
  Variant of Galactose Oxidase from Fusarium graminearum
atggcatcagcaccgatcggggtagccatcccgcgcaacaaatgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcggaatcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggttggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2390 - protein, 650 aa, Artificial Sequence
  Variant of Galactose Oxidase from Fusarium graminearum
MASAPIGVAIPRNKWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSESDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2391 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccaggggcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2392 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQGRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2393 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatggggggccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccatctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggctgctgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2394 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGGPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2395 - DNA, 1953 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccgtgaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgtcgtcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgaatgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggggattgtgagacgaaccactttgatgcgcaaatctttacgccgaattatctttacgatagcaacgggaacttagccactcgccctaaaatcacccgtacctcaacccagtcagtcgtggttggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2396 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAVTEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLNEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2397 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcaataaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagccgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcggcgtcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtactgactccagagatctacgttcccgaacaagatactttttacaaacaaaacccgaatagtatcgttcgtgcctatcattccatcagcttgttgctgccggacggacgtgttttcaatggtggcggtggcttatgcggggattgtgagacgaaccactttgatgcgcaaatctttacgccgaattatctttacgatagcaacgggaacttagccactcgccctaaaatcacccgtacctcaacccagtcagtcgtggttggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2398 - protein, 650 aa, Artificial Sequence
  Variant of Galactose Oxidase from Fusarium graminearum
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEPSPGGITLTSSWDPSTGIVSDRTSTVTGHDMFCPGISMDGNGQIVVSGGNDAKKTSLYDSASDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVLTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2399 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagctgtctcctggcggtattacactgacgagcgattgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2400 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFELSPGGITLTSDWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2401 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctggttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2402 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEMSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLVGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2403 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2404 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2405 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagcagctgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2406 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2407 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagcagctgggaccctagcactggaattgtatccgatcgcattagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2408 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRISTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2409 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2410 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEMSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2411 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2412 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEMSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2413 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggagccgtatccgatcgcaccagtaccgttaccgggcacgacatgttttgccccggtatctcgatggacgggaacggtcagatcgtggtcagcggtggtaatgatgcaaataaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtatctgacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2414 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGAVSDRTSTVTGHDMFCPGISMDGNGQIVVSGGNDANKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYLTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2415 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagcagctgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2416 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEMSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2417 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaaaggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2418 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVKGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2419 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2420 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2421 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacgcaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaataaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtacgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2422 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRTSTVTGHDMFCPGISMDGNGQIVVSGGNDANKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRTYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2423 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2424 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2425 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2426 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEMSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2427 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcactctcctggcggtattacactgacgagctcatgggaccctagcactggagccgtatccgatcgcaccagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2428 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEHSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2429 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2430 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2431 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2432 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2433 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagctgtctcctggcggtattacactgacgagcagctgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2434 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFELSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2435 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagcaagggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaattgtatccgatcgcaccagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2436 - protein, 650 aa, Artificial Sequence
  Variant of Galactose Oxidase from Fusarium graminearum
MASAPIGVAIPRNNWAVTCDSAQQGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2437 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagcagctgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2438 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2439 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2440 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2441 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2442 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEMSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2443 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2444 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2445 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2446 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2447 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagctgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2448 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFELSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2449 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagggttctcctggcggtattacactgacgagctcatgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2450 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEGSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2451 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagctcatgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2452 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEMSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2453 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactggctatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaataaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2454 - protein, 650 aa, Artificial Sequence
  Variant of Galactose Oxidase from Fusarium graminearum
MASAPIGVAIPRNNWAVTCDSAQSGNECIKAIDGNKDTFWHTGYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDANKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2455 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagctgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctggttgggaggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2456 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFELSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLVGRKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2457 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2458 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2459 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagctgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2460 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFELSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2461 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatgggcgtaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcaccagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2462 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGRNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2463 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2464 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2465 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagctcatgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2466 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEMSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2467 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2468 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2469 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2470 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFESSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2471 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaaaggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagcagctgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2472 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVKGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2473 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagctgtctcctggcggtattacactgacgagcgattgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2474 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFELSPGGITLTSDWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2475 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagcaagggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcaccagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2476 - protein, 650 aa, Artificial Sequence
  Variant of Galactose Oxidase from Fusarium graminearum
MASAPIGVAIPRNNWAVTCDSAQQGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2477 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagcaagggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcagtctcctggcggtattacactgacgagctcatgggaccctagcactggaattgtatccgatcgcaccagtaccgttaccgggcacgacatgttttgccccggtatctcgatggacgggaacggtcagatcgtggtcagcggtggtaatgatgcaaataaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttacgcttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2478 - protein, 650 aa, Artificial Sequence
  Variant of Galactose Oxidase from Fusarium graminearum
MASAPIGVAIPRNNWAVTCDSAQQGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEQSPGGITLTSSWDPSTGIVSDRTSTVTGHDMFCPGISMDGNGQIVVSGGNDANKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLRFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2479 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2480 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2481 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgtcccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2482 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2483 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcaccagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2484 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2485 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatgggcgtaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtatctgacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2486 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGRNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYLTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2487 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2488 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2489 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggattctcctggcggtattacactgacgagcagctgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2490 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2491 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagcgattgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2492 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSDWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2493 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactggctatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcaccagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtatctgacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2494 - protein, 650 aa, Artificial Sequence
  Variant of Galactose Oxidase from Fusarium graminearum
MASAPIGVAIPRNNWAVTCDSAQSGNECIKAIDGNKDTFWHTGYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYLTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2495 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagcgattgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2496 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEDSPGGITLTSDWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2497 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2498 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2499 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagatgtctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctggttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2500 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEMSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLVGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2501 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2502 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2503 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2504 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2505 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacaacccaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagagctctcctggcggtattacactgacgagcgattgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2506 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFESSPGGITLTSDWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2507 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagggttctcctggcggtattacactgacgagcgattgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcgtcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2508 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFEGSPGGITLTSDWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISSASLIRYGTATHTVNTDQRRIGLTLTNNGGNSYSFQVPSDSGVALPGYWMLFVMNSAGVPSVASTINVTQGQTGHHHHHH

SEQ ID NO: 2509 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagggttctcctggcggtattacactgacgagcgattgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccatatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgttgtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2510 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSDWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPIFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2511 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagcaagggaatgaatgcattaaggcaattgacggtaataaagacacgttttggcacactcaatatggtgtaaacggagatccccaaccgccgcacaccatcacgatcgatatgaaaacaacgcaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcaccagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtatctgacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2512 - protein, 650 aa, Artificial Sequence
  Variant of Galactose Oxidase from Fusarium graminearum
MASAPIGVAIPRNNWAVTCDSAQQGNECIKAIDGNKDTFWHTQYGVNGDPQPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYLTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2513 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagatgcgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagctgtctcctggcggtattacactgacgagctcatgggaccctagcactggagcggtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcggtgtcggcgggtggatcaccatttggactgacatgtcgatctcggcggcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2514 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFEMRPARYVRLVAITEANGQPWTSIAEINVFQASSYTAPQPGLGRWGPTIDLPIVPSAAAIEPTSGRVLMWSSYRQDAFELSPGGITLTSSWDPSTGAVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVGVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2515 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttagggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2516 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFRDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2517 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacggggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2518 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKRGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2519 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcgggattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2520 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYRDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2521 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccacgggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2522 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPREDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2523 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgcatcgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacgttccatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcctgtgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2524 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLHRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2525 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgttccatcggccgccgcaatcgagccaacgagcggtcgtgtcttgatgtggagctcgtatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctaccatacctcggtggtccttccggacgggagtgtattcatcacaggaggccagcagcgcggcgttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcctgtgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacactgtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2526 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTYHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2527 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgttccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtcaggatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctaccatacctcggtggtccttccggacgggagtgtattcatcacaggaggccagcagcgcggcgttccactggaagatagcacacccgtatttactccagagatctacgttcccgaacaagatactttttacaaacaaaacccgaatagtatcgttcgtgcctatcattcgatctcgttgttgctgccggacggacgtgttttcaatggtggcggtggcctgtgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2528 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGQDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTYHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2529 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcactctgtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2530 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHSVNTDQRRIGLTLTNNGGNSYSFQVPSDSGVALPGYWMLFVMNSAGVPSVASTINVTQGQTGHHHHHH

SEQ ID NO: 2531 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaaaagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2532 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKKGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2533 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgttccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtcaggatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaaaattcagatgcgactacaaatgcccatattatcacgctgggcgagcctggcacgagtccgaatacggtatttgcgagtaatgggttactgttcgctcgtacctaccatacctcggtggtccttccggacgggagtgtattcatcacaggaggccagcagcgcgccgttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcctgtgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2534 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGQDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQNSDATTNAHIITLGEPGTSPNTVFASNGLLFARTYHTSVVLPDGSVFITGGQQRAVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2535 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttataggggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2536 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYRGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2537 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacggggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2538 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHGVNTDQRRIGLTLTNNGGNSYSFQVPSDSGVALPGYWMLFVMNSAGVPSVASTINVTQGQTGHHHHHH

SEQ ID NO: 2539 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgttccatcggccgccgcaatcgagccaacgagcggtcgtgtcttgatgtggagctcgtatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcgccgttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacgctgtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2540 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRAVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHAVNTDQRRIGLTLTNNGGNSYSFQVPSDSGVALPGYWMLFVMNSAGVPSVASTINVTQGQTGHHHHHH

SEQ ID NO: 2541 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattataaggattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2542 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYKDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2543 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattgtatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2544 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHCISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2545 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttcaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2546 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFQDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2547 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacggggttggtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2548 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKRGWYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2549 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgttccatcggccgccgcaatcgagccaacgagcggtcgtgtcttgatgtggagctcttatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtagtgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctaccatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcctgtgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2550 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGSDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTYHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2551 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgttccatcggccgccgcaatcgagccaacgagcggtcgtgtcttgatgtggagctcgtatcgtcaggatgcgtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctaccatacctcggtggtccttccggacgggagtgtattcatcacaggaggccagcagcgcgccgttccactggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcatgtgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2552 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTYHTSVVLPDGSVFITGGQQRAVPLEDSTPVFTPEIYVPEQDTFYKQNPNSIVRAYHSISLLLPDGRVFNGGGGMCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2553 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgggtttgaggactctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgcatcgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtagttatcatagcatcagcttgttgctgccggacggacgtgttttcaatggtggcggtggcctgtgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacactgtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2554 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDGFEDSPGGITLTSSWDPSTGIVSDRTSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLHRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRSYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2555 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaacagtcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2556 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQQSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2557 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccctgcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2558 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPLQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2559 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaaataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2560 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGNNSYSFQVPSDSGVALPGYWMLFVMNSAGVPSVASTINVTQGQTGHHHHHH

SEQ ID NO: 2561 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2562 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2563 - DNA, 1950 bp, Artificial Sequence
  Variant of Galactose Oxidase from Fusarium graminearum
atggcatcagcaccgatcggggtagccatcccgcgcaacctgtgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2564 - protein, 650 aa, Artificial Sequence
  Variant of Galactose Oxidase from Fusarium graminearum
MASAPIGVAIPRNLWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2565 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgtgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaaggccaaactggccaccatcaccatcaccat

SEQ ID NO: 2566 - protein, 650 aa, Artificial Sequence
  Variant of Galactose Oxidase from Fusarium graminearum
MASAPIGVAIPRNRWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2567 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgggttatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2568 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2569 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaatgtggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2570 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVMWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2571 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaagttggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2572 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVSWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2573 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2574 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2575 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacaagtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2576 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETSPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2577 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatatggtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2578 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDMVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2579 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcaccctgacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2580 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITLTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2581 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2582 - protein, 650 aa, Artificial Sequence
  Variant of Galactose Oxidase from Fusarium graminearum
MASAPIGVAIPRNNWAVTCDSAQPGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2583 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattgtaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2584 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDCNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2585 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttgtgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2586 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSCDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2587 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtggtgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2588 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSGDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2589 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgtggatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2590 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSVDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2591 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggattgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2592 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2593 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggagttcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2594 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2595 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtcctaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2596 - protein, 650 aa, Artificial Sequence
  Variant of Galactose Oxidase from Fusarium graminearum
MASAPIGVAIPRNNWAVTCDSAQSGNECIKAIDGNKDTFWHTQYGPNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2597 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggctaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2598 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGANWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2599 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggattatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2600 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGIITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2601 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgtaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2602 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2603 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaggacacgttttggcacactcaatatggtgagaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtggcgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcaccctgacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2604 - protein, 650 aa, Artificial Sequence
  Variant of Galactose Oxidase from Fusarium graminearum
MASAPIGVAIPRNNWAVTCDSAQPGNECIKAIDGNKDTFWHTQYGENGDPKPPHTITIDMKTVQNVNGLSVLPRQDGNQNGWIGRHEVYLSGDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITLTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2605 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatctggacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaaataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2606 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGNNSYSFQVPSDSGVALPGYWMLFVMNSAGVPSVASTINVTQGQTGHHHHHH

SEQ ID NO: 2607 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaagacacgttttggcacactcaatatggtgagaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtggcgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2608 - protein, 650 aa, Artificial Sequence
  Variant of Galactose Oxidase from Fusarium graminearum
MASAPIGVAIPRNNWAVTCDSAQPGNECIKAIDGNKDTFWHTQYGENGDPKPPHTITIDMKTVQNVNGLSVLPRQDGNQNGWIGRHEVYLSGDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2609 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcggggagatcaccatttggactgacatgtcaatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2610 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGEITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2611 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaagacacgttttggcacactcaatatggtgagaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtggcgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2612 - protein, 650 aa, Artificial Sequence
  Variant of Galactose Oxidase from Fusarium graminearum
MASAPIGVAIPRNNWAVTCDSAQPGNECIKAIDGNKDTFWHTQYGENGDPKPPHTITIDMKTVQNVNGLSVLPRQDGNQNGWIGRHEVYLSGDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2613 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaatctggacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccctgcaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgtacctcaacccagtcagtcgtggtcggcggggagatcaccatttggactgacatgtcgatctcggccgcaagtttaattcgctacggaactgctactcacacggtgaacaccgatcagcgacgcatcggcttgacgttaacgaacaacggaaataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2614 - protein, 650 aa, Artificial Sequence
  Variant of Galactose Oxidase from Fusarium graminearum
MASAPIGVAIPRNNWAVTCDSAQPGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTSPNTVFASNGLLFARTFHTSVVLPDGSVFITGGQQRGVPLEDSTPVFTPEIYVPLQDTFCKQNPNSIVRAYHSISLLLPDGRVFNGGGGLCGDCETNHFDAQIFTPGYLYDSNGNLATRPKITRTSTQSVVVGGEITIWTDMSISAASLIRYGTATHTVNTDQRRIGLTLTNNGNNSYSFQVPSDSGVALPGYWMLFVMNSAGVPSVASTINVTQGQTGHHHHHH

SEQ ID NO: 2615 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2616 - protein, 650 aa, Artificial Sequence
  Variant of Galactose Oxidase from Fusarium graminearum
MASAPIGVAIPRNNWAVTCDSAQPGNECIKAIDGNKDTFWHTQYGVNGDPKPPHTITIDMKTVQNVNGLSVLPRQDGNQNGWIGRHEVYLSSDGVNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2617 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaggacacgttttggcacactcaatatggtgagaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2618 - protein, 650 aa, Artificial Sequence
  Variant of Galactose Oxidase from Fusarium graminearum
MASAPIGVAIPRNNWAVTCDSAQPGNECIKAIDGNKDTFWHTQYGENGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2619 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaatctggacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcaccctgacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaaataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2620 - protein, 650 aa, Artificial Sequence
  Variant of Galactose Oxidase from Fusarium graminearum
MASAPIGVAIPRNNWAVTCDSAQPGNECIKAIDGNLDTFWHTQYGVNGDPKPPHTITIDMKTVQNVNGLSVLPRQDGNQNGWIGRHEVYLSSDGVNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITLTSTQSVVVGGWITIWTDMSISAASLIRYGTATHTVNTDQRRIGLTLTNNGNNSYSFQVPSDSGVALPGYWMLFVMNSAGVPSVASTINVTQGQTGHHHHHH

SEQ ID NO: 2621 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaggacacgttttggcacactcaatatggtgagaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcaccctgacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaaataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2622 - protein, 650 aa, Artificial Sequence
  Variant of Galactose Oxidase from Fusarium graminearum
MASAPIGVAIPRNNWAVTCDSAQPGNECIKAIDGNKDTFWHTQYGENGDPKPPHTITIDMKTVQNVNGLSVLPRQDGNQNGWIGRHEVYLSSDGVNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITLTSTQSVVVGGWITIWTDMSISAASLIRYGTATHTVNTDQRRIGLTLTNNGNNSYSFQVPSDSGVALPGYWMLFVMNSAGVPSVASTINVTQGQTGHHHHHH

SEQ ID NO: 2623 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtggcgatgggtcgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcaccctgacctcaacccagtcagtcgtggtcggcggggagatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2624 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSGDGSNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPGYLYDSNGNLATRPKITLTSTQSVVVGGEITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2625 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaatctggacacgttttggcacactcaatatggtgagaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcaccctgacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2626 - protein, 650 aa, Artificial Sequence
  Variant of Galactose Oxidase from Fusarium graminearum
MASAPIGVAIPRNNWAVTCDSAQPGNECIKAIDGNLDTFWHTQYGENGDPKPPHTITIDMKTVQNVNGLSVLPRQDGNQNGWIGRHEVYLSSDGVNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITLTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2627 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccctgcaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2628 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPLQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2629 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaatctggacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtggcgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2630 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSGDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2631 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaagacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaaataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2632 - protein, 650 aa, Artificial Sequence
  Variant of Galactose Oxidase from Fusarium graminearum
MASAPIGVAIPRNNWAVTCDSAQPGNECIKAIDGNKDTFWHTQYGVNGDPKPPHTITIDMKTVQNVNGLSVLPRQDGNQNGWIGRHEVYLSSDGVNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTSPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGNNSYSFQVPSDSGVALPGYWMLFVMNSAGVPSVASTINVTQGQTGHHHHHH

SEQ ID NO: 2633 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2634 - protein, 650 aa, Artificial Sequence
  Variant of Galactose Oxidase from Fusarium graminearum
MASAPIGVAIPRNNWAVTCDSAQPGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2635 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtcgccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2636 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2637 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaggacacgttttggcacactcaatatggtgagaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatgggtcgaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2638 - protein, 650 aa, Artificial Sequence
  Variant of Galactose Oxidase from Fusarium graminearum
MASAPIGVAIPRNNWAVTCDSAQPGNECIKAIDGNKDTFWHTQYGENGDPKPPHTITIDMKTVQNVNGLSVLPRQDGNQNGWIGRHEVYLSSDGSNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2639 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaggacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtcgccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccctgcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcaccctgacctcaacccagtcagtcgtggtcggcggggagatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2640 - protein, 650 aa, Artificial Sequence
  Variant of Galactose Oxidase from Fusarium graminearum
MASAPIGVAIPRNNWAVTCDSAQPGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTSPNTVFASNGLLFARTFHTSVVLPDGSVFITGGQQRGVPLEDSTPVFTPEIYVPLQDTFYKQNPNSIVRAYHSISLLLPDGRVFNGGGGLCGDCETNHFDAQIFTPGYLYDSNGNLATRPKITLTSTQSVVVGGEITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2641 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatggggtgatgtggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2642 - protein, 650 aa, Artificial Sequence
  Variant of Galactose Oxidase from Fusarium graminearum
MASAPIGVAIPRNNWAVTCDSAQPGNECIKAIDGNKDTFWHTQYGVNGDPKPPHTITIDMKTVQNVNGLSVLPRQDGNQNGWIGRHEVYLSSDGVMWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2643 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaatctggacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtggcgatgggtcgaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcggggagatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2644 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSGDGSNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGEITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2645 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaggacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccctgcaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2646 - protein, 650 aa, Artificial Sequence
  Variant of Galactose Oxidase from Fusarium graminearum
MASAPIGVAIPRNNWAVTCDSAQPGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTSPNTVFASNGLLFARTFHTSVVLPDGSVFITGGQQRGVPLEDSTPVFTPEIYVPLQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2647 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatggggtgatgtggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcaccctgacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2648 - protein, 650 aa, Artificial Sequence
  Variant of Galactose Oxidase from Fusarium graminearum
MASAPIGVAIPRNNWAVTCDSAQPGNECIKAIDGNLDTFWHTQYGVNGDPKPPHTITIDMKTVQNVNGLSVLPRQDGNQNGWIGRHEVYLSSDGVMWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITLTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2649 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcaccctgacctcaacccagtcagtcgtggtcggcggggagatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2650 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITLTSTQSVVVGGEITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2651 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatgggtcgaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2652 - protein, 650 aa, Artificial Sequence
  Variant of Galactose Oxidase from Fusarium graminearum
MASAPIGVAIPRNNWAVTCDSAQPGNECIKAIDGNLDTFWHTQYGVNGDPKPPHTITIDMKTVQNVNGLSVLPRQDGNQNGWIGRHEVYLSSDGSNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2653 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcaccctgacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaaataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2654 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITLTSTQSVVVGGWITIWTDMSISAASLIRYGTATHTVNTDQRRIGLTLTNNGNNSYSFQVPSDSGVALPGYWMLFVMNSAGVPSVASTINVTQGQTGHHHHHH

SEQ ID NO: 2655 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatgggtcgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2656 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGSNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2657 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaataaggacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaaataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2658 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTSPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGNNSYSFQVPSDSGVALPGYWMLFVMNSAGVPSVASTINVTQGQTGHHHHHH

SEQ ID NO: 2659 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaagacacgttttggcacactcaatatggtgtgaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2660 - protein, 650 aa, Artificial Sequence
  Variant of Galactose Oxidase from Fusarium graminearum
MASAPIGVAIPRNNWAVTCDSAQPGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2661 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaaattggggactgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatatggtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagactcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggattatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2662 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSVDGVNWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDMVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGIITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2663 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtccgaatggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaaattggggaagtcctgtagcgtctgggtcctggtttgccgattccaccacaaagtactctaattttgagacacgcccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggattatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2664 - protein, 650 aa, Artificial Sequence
  Variant of Galactose Oxidase from Fusarium graminearum
MASAPIGVAIPRNNWAVTCDSAQSGNECIKAIDGNKDTFWHTQYGPNGDPKPPHTITIDMKTVQNVNGLSVLPRQDGNQNGWIGRHEVYLSVDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGIITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2665 - DNA, 1950 bp, Artificial Sequence
  Variant of Galactose Oxidase from Fusarium graminearum
atggcatcagcaccgatcggggtagccatcccgcgcaacctgtgggccgttacatgcgattccgcccagtcggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaagttggggaagtcctgtagcgtctgggtcctggtttgccgattccaccacaaagtactctaattttgagacaagcccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgtgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagacatgggagtagccccagacgccatgtgcggtaatgccgtaatgtacgacgcagtcaaaggcaaaattttgactttcgggggctcgcccgattatcaagactcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2666 - protein, 650 aa, Artificial Sequence
  Variant of Galactose Oxidase from Fusarium graminearum
MASAPIGVAIPRNLWAVTCDSAQSGNECIKAIDGNKDTFWHTQYGVNGDPKPPHTITIDMKTVQNVNGLSVLPRQDGNQNGWIGRHEVYLSVDGVSWGSPVASGSWFADSTTKYSNFETSPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDMGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2667 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaacaatcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2668 - protein, 650 aa, Artificial Sequence
  Variant of Galactose Oxidase from Fusarium graminearum
MASAPIGVAIPRNRWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQQSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2669 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagtcggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagacatgggagtagccccagacgccatgtgcggtaatgccgtaatgtacgacgcagtcaaaggcaaaattttgactttcgggggctcgcccgattatcaagactcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggattatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2670 - protein, 650 aa, Artificial Sequence
  Variant of Galactose Oxidase from Fusarium graminearum
MASAPIGVAIPRNRWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDMGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGIITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2671 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagtcggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaagttggggactgcctgtagcgtctgggtcctggtttgccgattccaccacaaagtactctaattttgagacacgcccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2672 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVSWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2673 - DNA, 1950 bp, Artificial Sequence
  Variant of Galactose Oxidase from Fusarium graminearum
atggcatcagcaccgatcggggtagccatcccgcgcaacctgtgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaagttggggactgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgtgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2674 - protein, 650 aa, Artificial Sequence
  Variant of Galactose Oxidase from Fusarium graminearum
MASAPIGVAIPRNLWAVTCDSAQSGNECIKAIDGNKDTFWHTQYGVNGDPKPPHTITIDMKTVQNVNGLSVLPRQDGNQNGWIGRHEVYLSVDGVSWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2675 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaaattggggactgcctgtagcgtctgggtcctggtttgccgattccaccacaaagtactctaattttgagacaagcccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgtgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattgcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2676 - protein, 650 aa, Artificial Sequence
  Variant of Galactose Oxidase from Fusarium graminearum
MASAPIGVAIPRNRWAVTCDSAQSGNECIKAIDGNKDTFWHTQYGVNGDPKPPHTITIDMKTVQNVNGLSVLPRQDGNQNGWIGRHEVYLSVDGVNWGLPVASGSWFADSTTKYSNFETSPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDCNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2677 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagccggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttgcgatggggtaagttggggactgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaacgttcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2678 - protein, 650 aa, Artificial Sequence
  Variant of Galactose Oxidase from Fusarium graminearum
MASAPIGVAIPRNRWAVTCDSAQPGNECIKAIDGNKDTFWHTQYGVNGDPKPPHTITIDMKTVQNVNGLSVLPRQDGNQNGWIGRHEVYLSCDGVSWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQRSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2679 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatgggcgcaactggggatcgcctgtagcgtctgggtcctggtttgccgattccaccacaaagtactctaattttgagacactgccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatggcgctggtgtaccctccgttgcgtcgacgattaacgttacccagggccaaactggccaccatcaccatcaccat

SEQ ID NO: 2680 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGRNWGSPVASGSWFADSTTKYSNFETLPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNGAGVPSVASTINVTQGQTGHHHHHH

SEQ ID NO: 2681 - DNA, 1950 bp, Artificial Sequence
  Variant of Galactose Oxidase from Fusarium graminearum
atggcatcagcaccgatcggggtagccatcccgcgcaacctgtgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaagttggggactgcctgtagcgtctgggtcctggtttgccgattccaccacaaagtactctaattttgagacaagcccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagactcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattgcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2682 - protein, 650 aa, Artificial Sequence
  Variant of Galactose Oxidase from Fusarium graminearum
MASAPIGVAIPRNLWAVTCDSAQSGNECIKAIDGNKDTFWHTQYGVNGDPKPPHTITIDMKTVQNVNGLSVLPRQDGNQNGWIGRHEVYLSVDGVSWGLPVASGSWFADSTTKYSNFETSPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDCNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2683 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccaggtagggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcattcagaatggatggatcggacgtcacgaggtgtatttaagttctgatggggtaaattggggatcgcctgtagcgtctgggtcctggtttgccgattccaccacaaagtactctaattttgagacactgccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtagactcttggattccgggcccggatatgcaggtcgcgcgtgggtataactcaagtgcgactatgagtgatgggcgcgtatttacgattggcggcagttattccggcggtcaagtggagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgagcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2684 - protein, 650 aa, Artificial Sequence
  Variant of Galactose Oxidase from Fusarium graminearum
MASAPIGVAIPRNAWAVTCDSAQVGNECIKAIDGNKDTFWHTQYGVNGDPKPPHTITIDMKTVQNVNGLSVLPRQDGIQNGWIGRHEVYLSSDGVNWGSPVASGSWFADSTTKYSNFETLPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2685 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccaggtagggaatgaatgcattaaggcaattgacggtaatcctgacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtcggctggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaagtggagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctgggacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2686 - protein, 650 aa, Artificial Sequence
  Variant of Galactose Oxidase from Fusarium graminearum
MASAPIGVAIPRNAWAVTCDSAQVGNECIKAIDGNPDTFWHTQYGVNGDPKPPHTITIDMKTVQNVNGLSVLPRQDGNQNGWIGRHEVYLSSDGVGWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2687 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccaggtagggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2688 - protein, 650 aa, Artificial Sequence
  Variant of Galactose Oxidase from Fusarium graminearum
MASAPIGVAIPRNNWAVTCDSAQVGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2689 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccaggtagggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtcggctggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtagactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatggcgctggtgtaccctccgttgcgtcgacgattaacgttacccagggccaaactggccaccatcaccatcaccat

SEQ ID NO: 2690 - protein, 650 aa, Artificial Sequence
  Variant of Galactose Oxidase from Fusarium graminearum
MASAPIGVAIPRNAWAVTCDSAQVGNECIKAIDGNKDTFWHTQYGVNGDPKPPHTITIDMKTVQNVNGLSVLPRQDGNQNGWIGRHEVYLSSDGVGWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNGAGVPSVASTINVTQGQTGHHHHHH

SEQ ID NO: 2691 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacactgccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaagtggagaagaacggggaggtttactccccgagctcgaagacttggacttcgctgccgaatgcaaaagttaaccccatgctgacctttgataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttccccgccaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2692 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETLPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTFDKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPRQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2693 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcattcagaatggatggatcggacgtcacgaggtgtatttaagttctgatggggtaaattggggatcgcctgtagcgtctgggtcctggtttgccgattccaccacaaagtactctaattttgagacactgccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtagactcttggattccgggcccggatatgcaggtcgcgcgtgggtataactcaagtgcgactatgagtgatgggcgcgtatttacgattggcggcagttattccggcggtcaagtggagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgagcaagatactttttacaaacaaaccccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatggcgctggtgtaccctccgttgcgtcgacgattaacgttacccagggccaaactggccaccatcaccatcaccat

SEQ ID NO: 2694 - protein, 650 aa, Artificial Sequence
  Variant of Galactose Oxidase from Fusarium graminearum
MASAPIGVAIPRNAWAVTCDSAQSGNECIKAIDGNKDTFWHTQYGVNGDPKPPHTITIDMKTVQNVNGLSVLPRQDGIQNGWIGRHEVYLSSDGVNWGSPVASGSWFADSTTKYSNFETLPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQTPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNGAGVPSVASTINVTQGQTGHHHHHH

SEQ ID NO: 2695 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccaggtagggaatgaatgcattaaggcaattgacggtaatcctgacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatgggcgcggctggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagtggagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctgggacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2696 - protein, 650 aa, Artificial Sequence
  Variant of Galactose Oxidase from Fusarium graminearum
MASAPIGVAIPRNNWAVTCDSAQVGNECIKAIDGNPDTFWHTQYGVNGDPKPPHTITIDMKTVQNVNGLSVLPRQDGNQNGWIGRHEVYLSSDGRGWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2697 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccaggtagggaatgaatgcattaaggcaattgacggtaatcctgacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacactgccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttccccgccaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2698 - protein, 650 aa, Artificial Sequence
  Variant of Galactose Oxidase from Fusarium graminearum
MASAPIGVAIPRNNWAVTCDSAQVGNECIKAIDGNPDTFWHTQYGVNGDPKPPHTITIDMKTVQNVNGLSVLPRQDGNQNGWIGRHEVYLSSDGVNWGSPVASGSWFADSTTKYSNFETLPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPRQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2699 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatcctgacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtagactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgagcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2700 - protein, 650 aa, Artificial Sequence
  Variant of Galactose Oxidase from Fusarium graminearum
MASAPIGVAIPRNNWAVTCDSAQSGNECIKAIDGNPDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQREKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2701 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtcggctggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaagtggagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgagcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatagcgctggtgtaccctccgttgcgtcgacgattaacgttacccagggccaaactggccaccatcaccatcaccat

SEQ ID NO: 2702 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVGWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2703 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtcctgtggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtagactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatggcgctggtgtaccctccgttgcgtcgacgattaacgttacccagggccaaactggccaccatcaccatcaccat

SEQ ID NO: 2704 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVLWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNGAGVPSVASTINVTQGQTGHHHHHH

SEQ ID NO: 2705 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccaggtagggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtagactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2706 - protein, 650 aa, Artificial Sequence
  Variant of Galactose Oxidase from Fusarium graminearum
MASAPIGVAIPRNAWAVTCDSAQVGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2707 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccaggtagggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgacctttgataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttccccgccaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2708 - protein, 650 aa, Artificial Sequence
  Variant of Galactose Oxidase from Fusarium graminearum
MASAPIGVAIPRNNWAVTCDSAQVGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTFDKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPRQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2709 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgacctttgataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatagcgctggtgtaccctccgttgcgtcgacgattaacgttacccagggccaaactggccaccatcaccatcaccat

SEQ ID NO: 2710 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTFDKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2711 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgacctttgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgagcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2712 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTFDKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2713 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgacctttgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2714 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTFDKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2715 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtagactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgagcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2716 - protein, 650 aa, Artificial Sequence
  Variant of Galactose Oxidase from Fusarium graminearum
MASAPIGVAIPRNAWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQREKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2717 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtcaactggggatcgcctgtagcgtctgggtcctggtttgccgattccaccacaaagtactctaattttgagacactgccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaagtggagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttccccgccaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatggcgctggtgtaccctccgttgcgtcgacgattaacgttacccagggccaaactggccaccatcaccatcaccat

SEQ ID NO: 2718 - protein, 650 aa, Artificial Sequence
  Variant of Galactose Oxidase from Fusarium graminearum
MASAPIGVAIPRNAWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETLPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPRQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNGAGVPSVASTINVTQGQTGHHHHHH

SEQ ID NO: 2719 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttccccgccaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2720 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPRQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2721 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccaggtagggaatgaatgcattaaggcaattgacggtaatcctgacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagccttggacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgagcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatagcgctggtgtaccctccgttgcgtcgacgattaacgttacccagggccaaactggccaccatcaccatcaccat

SEQ ID NO: 2722 - protein, 650 aa, Artificial Sequence
  Variant of Galactose Oxidase from Fusarium graminearum
MASAPIGVAIPRNAWAVTCDSAQVGNECIKAIDGNPDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPWTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2723 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatcctgacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtagactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgacctttgataaacagggtctgtaccgtagcgataatcatgcttggctgtttgggtggaaaaagggtagcgtcttccaagcaggtccaagtactgccatgaactggtattatacatcggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctgggacgagtccgaatacggtatttgcgggtaatgggttactgttcgctcgtacctttcatacctcggtggtccttccggacgggagtgtattcatcacaggaggccagcagcgcggagttccactggaagatagcacacccgtatttactccagagatctacgttcccgagcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatggcgctggtgtaccctccgttgcgtcgacgattaacgttacccagggccaaactggccaccatcaccatcaccat

SEQ ID NO: 2724 - protein, 650 aa, Artificial Sequence
  Variant of Galactose Oxidase from Fusarium graminearum
MASAPIGVAIPRNNWAVTCDSAQSGNECIKAIDGNPDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQREKNGEVYSPSSKTWTSLPNAKVNPMLTFDKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFAGNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNGAGVPSVASTINVTQGQTGHHHHHH

SEQ ID NO: 2725 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatgggcgcaactggggatcgcctgtagcgtctgggtcctggtttgccgattccaccacaaagtactctaattttgagacactgccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttccccgccaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2726 - protein, 650 aa, Artificial Sequence
  Variant of Galactose Oxidase from Fusarium graminearum
MASAPIGVAIPRNAWAVTCDSAQSGNECIKAIDGNKDTFWHTQYGVNGDPKPPHTITIDMKTVQNVNGLSVLPRQDGNQNGWIGRHEVYLSSDGRNWGSPVASGSWFADSTTKYSNFETLPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPRQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2727 - DNA, 1950 bp, Artificial Sequence
  Variant of Galactose Oxidase from Fusarium graminearum
atggcatcagcaccgatcggggtagccatcccgcgcaacgcttgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtcaactggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtagactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgcggataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgagcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2728 - protein, 650 aa, Artificial Sequence
  Variant of Galactose Oxidase from Fusarium graminearum
MASAPIGVAIPRNAWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2729 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatggggtcaactggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattggaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttacaaaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2730 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDWNGNLATRPKITRTSTQSVVVGGWITIWTDMSISAASLIRYGTATHTVNTDQRRIGLTLQNNGGNSYSFQVPSDSGVALPGYWMLFVMNSAGVPSVASTINVTQGQTGHHHHHH

SEQ ID NO: 2731 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttgcgatgggttcggctggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2732 - protein, 650 aa, Artificial Sequence
  Variant of Galactose Oxidase from Fusarium graminearum
MASAPIGVAIPRNNWAVTCDSAASGNECIKAIDGNLDTFWHTQYGVNGDPKPPHTITIDMKTVQNVNGLSVLPRQDGNQNGWIGRHEVYLSCDGFGWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2733 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattggaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttacaaaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2734 - protein, 650 aa, Artificial Sequence
  Variant of Galactose Oxidase from Fusarium graminearum
MASAPIGVAIPRNNWAVTCDSAASGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDWNGNLATRPKITRTSTQSVVVGGWITIWTDMSISAASLIRYGTATHTVNTDQRRIGLTLQNNGGNSYSFQVPSDSGVALPGYWMLFVMNSAGVPSVASTINVTQGQTGHHHHHH

SEQ ID NO: 2735 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttgcgatgggttcaactggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgcacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattcgaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttacaaaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2736 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSCDGFNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPHTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLQNNGGNSYSFQVPSDSGVALPGYWMLFVMNSAGVPSVASTINVTQGQTGHHHHHH

SEQ ID NO: 2737 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattggaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccgcggccaaactggccaccatcaccatcaccat

SEQ ID NO: 2738 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDWNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTRGQTGHHHHHH

SEQ ID NO: 2739 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttacaaaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2740 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLQNNGGNSYSFQVPSDSGVALPGYWMLFVMNSAGVPSVASTINVTQGQTGHHHHHH

SEQ ID NO: 2741 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatggcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaactaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2742 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDGVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2743 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaataaggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatggcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattggaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaactaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2744 - protein, 650 aa, Artificial Sequence
  Variant of Galactose Oxidase from Fusarium graminearum
MASAPIGVAIPRNNWAVTCDSAASGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDGVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDWNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2745 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttagttaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2746 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLVNNGGNSYSFQVPSDSGVALPGYWMLFVMNSAGVPSVASTINVTQGQTGHHHHHH

SEQ ID NO: 2747 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttgcgatggggtcggctggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgcacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattcgaacgggcgtttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttagttaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2748 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSCDGVGWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPHTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGRLATRPKITRTSTQSVVVGGWITIWTDMSISAASLIRYGTATHTVNTDQRRIGLTLVNNGGNSYSFQVPSDSGVALPGYWMLFVMNSAGVPSVASTINVTQGQTGHHHHHH

SEQ ID NO: 2749 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttagttaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2750 - protein, 650 aa, Artificial Sequence
  Variant of Galactose Oxidase from Fusarium graminearum
MASAPIGVAIPRNNWAVTCDSAASGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLVNNGGNSYSFQVPSDSGVALPGYWMLFVMNSAGVPSVASTINVTQGQTGHHHHHH

SEQ ID NO: 2751 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgcacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2752 - protein, 650 aa, Artificial Sequence
  Variant of Galactose Oxidase from Fusarium graminearum
MASAPIGVAIPRNNWAVTCDSAASGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPHTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2753 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttgcgatgggttcaactggggattccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttagttaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2754 - protein, 650 aa, Artificial Sequence
  Variant of Galactose Oxidase from Fusarium graminearum
MASAPIGVAIPRNNWAVTCDSAASGNECIKAIDGNLDTFWHTQYGVNGDPKPPHTITIDMKTVQNVNGLSVLPRQDGNQNGWIGRHEVYLSCDGFNWGFPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLVNNGGNSYSFQVPSDSGVALPGYWMLFVMNSAGVPSVASTINVTQGQTGHHHHHH

SEQ ID NO: 2755 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatgggttcaactggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2756 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGFNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2757 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgaacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattcgaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2758 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2759 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatggggtgatgtggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcggggagatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2760 - protein, 650 aa, Artificial Sequence
  Variant of Galactose Oxidase from Fusarium graminearum
MASAPIGVAIPRNNWAVTCDSAQPGNECIKAIDGNKDTFWHTQYGVNGDPKPPHTITIDMKTVQNVNGLSVLPRQDGNQNGWIGRHEVYLSSDGVMWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGEITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2761 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaaagggagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2762 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2763 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttccccggcaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2764 - protein, 650 aa, Artificial Sequence; identical to SEQ ID NO: 2720
  Variant of Galactose Oxidase from Fusarium graminearum

SEQ ID NO: 2765 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccaggtggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2766 - protein, 650 aa, Artificial Sequence
  Variant of Galactose Oxidase from Fusarium graminearum
MASAPIGVAIPRNNWAVTCDSAQVGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2767 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacttccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2768 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETLPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2769 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2770 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2771 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcattcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2772 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGIQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2773 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtggggatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2774 - protein, 650 aa, Artificial Sequence; identical to SEQ ID NO: 2588
  Variant of Galactose Oxidase from Fusarium graminearum

SEQ ID NO: 2775 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtagggtggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2776 - protein, 650 aa, Artificial Sequence; identical to SEQ ID NO: 2702
  Variant of Galactose Oxidase from Fusarium graminearum

SEQ ID NO: 2777 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcgtggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2778 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSVDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2779 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacaccggggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2780 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTPGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2781 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaatggtgctggtgtaccctccgttgcgtcgacgattaacgttacccagggccaaactggccaccatcaccatcaccat

SEQ ID NO: 2782 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNGAGVPSVASTINVTQGQTGHHHHHH

SEQ ID NO: 2783 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2784 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2785 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtcgccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2786 - protein, 650 aa, Artificial Sequence; identical to SEQ ID NO: 2574
  Variant of Galactose Oxidase from Fusarium graminearum

SEQ ID NO: 2787 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagtcggggaatgaatgcattaaggcaattgacggtaataaggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcaccctgacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2788 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITLTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2789 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagccggggaatgaatgcattaaggcaattgacggtaataaggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccggggtatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2790 - protein, 650 aa, Artificial Sequence
  Variant of Galactose Oxidase from Fusarium graminearum
MASAPIGVAIPRNNWAVTCDSAQPGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPGYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2791 - DNA, 1950 bp, Artificial Sequence; identical to SEQ ID NO: 2649
  Variant of Galactose Oxidase from Fusarium graminearum

SEQ ID NO: 2792 - protein, 650 aa, Artificial Sequence; identical to SEQ ID NO: 2650
  Variant of Galactose Oxidase from Fusarium graminearum

SEQ ID NO: 2793 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgcacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2794 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTWPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2795 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatggggtgaattggggagtgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcctgattatcaagattcagatgcgactacaaatgcccatattatcacgctgggcgagcctggcacgtggccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttgcaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaaataattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2796 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSSDGVNWGVPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTWPNTVFASNGLLFARTFHTSVVLPDGSVFITGGQQRGVPLEDSTPVFTPEIYVPEQDTFCKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGNNSYSFQVPSDSGVALPGYWMLFVMNSAGVPSVASTINVTQGQTGHHHHHH

SEQ ID NO: 2797 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtggcgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcggctgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2798 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSGDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSADYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2799 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgacctttgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2800 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTFDKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2801 - DNA, 1953 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaatgtggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 2802 - protein, 650 aa, Artificial Sequence; identical to SEQ ID NO: 2570
  Variant of Galactose Oxidase from Fusarium graminearum

SEQ ID NO: 2803 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagccggggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggactgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatatggtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaacaatcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattgcaacgggaacttagccactcgccctaaaatcacccgtacctcaacccagtcagtcgtggtcggcgggattatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2804 - protein, 650 aa, Artificial Sequence
  Variant of Galactose Oxidase from Fusarium graminearum
MASAPIGVAIPRNRWAVTCDSAQPGNECIKAIDGNKDTFWHTQYGVNGDPKPPHTITIDMKTVQNVNGLSVLPRQDGNQNGWIGRHEVYLSSDGVNWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDMVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQQSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDCNGNLATRPKITRTSTQSVVVGGIITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2805 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattgcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2806 - protein, 650 aa, Artificial Sequence
  Variant of Galactose Oxidase from Fusarium graminearum
MASAPIGVAIPRNRWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDCNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2807 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagagtgggaatgaatgcattaaggcaattgacggtaataaagacacgttttggcacactcaatatggtccgaatggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatggggtaagttggggactgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagactcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggattatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2808 - protein, 650 aa, Artificial Sequence
  Variant of Galactose Oxidase from Fusarium graminearum
MASAPIGVAIPRNRWAVTCDSAQSGNECIKAIDGNKDTFWHTQYGPNGDPKPPHTITIDMKTVQNVNGLSVLPRQDGNQNGWIGRHEVYLSSDGVSWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGIITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2809 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaaattggggactgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatatggtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaacaatcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2810 - protein, 650 aa, Artificial Sequence
  Variant of Galactose Oxidase from Fusarium graminearum
MASAPIGVAIPRNRWAVTCDSAQSGNECIKAIDGNKDTFWHTQYGVNGDPKPPHTITIDMKTVQNVNGLSVLPRQDGNQNGWIGRHEVYLSVDGVNWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDMVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQQSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2811 - DNA, 1950 bp, Artificial Sequence
  Variant of Galactose Oxidase from Fusarium graminearum
atggcatcagcaccgatcggggtagccatcccgcgcaacctgtgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagacatgggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattgcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2812 - protein, 650 aa, Artificial Sequence
  Variant of Galactose Oxidase from Fusarium graminearum
MASAPIGVAIPRNLWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDMGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDCNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2813 - DNA, 1950 bp, Artificial Sequence
  Variant of Galactose Oxidase from Fusarium graminearum
atggcatcagcaccgatcggggtagccatcccgcgcaacctgtgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaaattggggactgcctgtagcgtctgggtcctggtttgccgattccaccacaaagtactctaattttgagacaagcccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatatggtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaacgttcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2814 - protein, 650 aa, Artificial Sequence
  Variant of Galactose Oxidase from Fusarium graminearum
MASAPIGVAIPRNLWAVTCDSAQSGNECIKAIDGNKDTFWHTQYGVNGDPKPPHTITIDMKTVQNVNGLSVLPRQDGNQNGWIGRHEVYLSVDGVNWGLPVASGSWFADSTTKYSNFETSPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDMVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQRSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2815 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttgcgatggggtaagttggggaagtcctgtagcgtctgggtcctggtttgccgattccaccacaaagtactctaattttgagacacgcccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagacatgggagtagccccagacgccatgtgcggtaatgccgtaatgtacgacgcagtcaaaggcaaaattttgactttcgggggctcgcccgattatcaagactcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2816 - protein, 650 aa, Artificial Sequence
  Variant of Galactose Oxidase from Fusarium graminearum
MASAPIGVAIPRNRWAVTCDSAQSGNECIKAIDGNKDTFWHTQYGVNGDPKPPHTITIDMKTVQNVNGLSVLPRQDGNQNGWIGRHEVYLSCDGVSWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDMGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2817 - DNA, 1950 bp, Artificial Sequence
  Variant of Galactose Oxidase from Fusarium graminearum
atggcatcagcaccgatcggggtagccatcccgcgcaacctgtgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgtgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagacatgggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2818 - protein, 650 aa, Artificial Sequence
  Variant of Galactose Oxidase from Fusarium graminearum
MASAPIGVAIPRNLWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDMGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2819 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaaattggggaagtcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatatggtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2820 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSVDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDMVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2821 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaagttggggactgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagacatgggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggattatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2822 - protein, 650 aa, Artificial Sequence
  Variant of Galactose Oxidase from Fusarium graminearum
MASAPIGVAIPRNRWAVTCDSAQSGNECIKAIDGNKDTFWHTQYGVNGDPKPPHTITIDMKTVQNVNGLSVLPRQDGNQNGWIGRHEVYLSVDGVSWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDMGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGIITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2823 - DNA, 1950 bp, Artificial Sequence
  Variant of Galactose Oxidase from Fusarium graminearum
atggcatcagcaccgatcggggtagccatcccgcgcaacctgtgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttgcgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatatggtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaacaatcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2824 - protein, 650 aa, Artificial Sequence
  Variant of Galactose Oxidase from Fusarium graminearum
MASAPIGVAIPRNLWAVTCDSAQSGNECIKAIDGNKDTFWHTQYGVNGDPKPPHTITIDMKTVQNVNGLSVLPRQDGNQNGWIGRHEVYLSCDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDMVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQQSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2825 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatggggtcggctggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgaacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattcgaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttagttaacaacggaggtaattcgtacagctttcaagttccgtcggacagcggggttgctcttccgggatactggatgttgttcgttatgaattccgctggtgtaccctccgttgcgtcgacgattaacgttacccgcggccaaactggccaccatcaccatcaccat

SEQ ID NO: 2826 - protein, 650 aa, Artificial Sequence
  Variant of Galactose Oxidase from Fusarium graminearum
MASAPIGVAIPRNNWAVTCDSAASGNECIKAIDGNLDTFWHTQYGVNGDPKPPHTITIDMKTVQNVNGLSVLPRQDGNQNGWIGRHEVYLSSDGVGWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLVNNGGNSYSFQVPSDSGVALPGYWMLFVMNSAGVPSVASTINVTRGQTGHHHHHH

SEQ ID NO: 2827 - DNA, 1950 bp, Artificial Sequence
  Variant of Galactose Oxidase from Fusarium graminearum
atggcatcagcaccgatcggggtagccatcccgcgcaaccgctgggccgttacatgcgattccgcccagagtgggaatgaatgcattaaggcaattgacggtaataaagacacgttttggcacactcaatatggtccgccaggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagacatgggagtagccccagacgccatgtgcggtaatgccgtaatgtacgacgcagtcaaaggcaaaattttgactttcgggggctcgcccgattatcaagactcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2828 - protein, 650 aa, Artificial Sequence
  Variant of Galactose Oxidase from Fusarium graminearum
MASAPIGVAIPRNRWAVTCDSAQSGNECIKAIDGNKDTFWHTQYGPPGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDMGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2829 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgaacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2830 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2831 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaagttggggaagtcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2832 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSVDGVSWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2833 - DNA, 1950 bp, Artificial Sequence
  Variant of Galactose Oxidase from Fusarium graminearum
atggcatcagcaccgatcggggtagccatcccgcgcaacctgtgggccgttacatgcgattccgcccagagtgggaatgaatgcattaaggcaattgacggtaataaagacacgttttggcacactcaatatggtgtcaatggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgtgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagacatgggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggattatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2834 - protein, 650 aa, Artificial Sequence
  Variant of Galactose Oxidase from Fusarium graminearum
MASAPIGVAIPRNLWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDMGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGIITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2835 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtataactcaagtgcgactatgagtgatgggcgcgtatttacgattggcggcagttattccggcggtcaacgtgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttccccgccaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggatgatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2836 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQREKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPRQDTFYKQNPNSIVRAYHSISLLLPDGRVFNGGGGLCGDCETNHFDAQIFTPNYLYDSNGNLATRPKITRTSTQSVVVGGMITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2837 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacaagcccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagacatgggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2838 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETSPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDMGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2839 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattggaacgggcgtttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccgcggccaaactggccaccatcaccatcaccat

SEQ ID NO: 2840 - protein, 650 aa, Artificial Sequence
  Variant of Galactose Oxidase from Fusarium graminearum
MASAPIGVAIPRNNWAVTCDSAASGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDWNGRLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTRGQTGHHHHHH

SEQ ID NO: 2841 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagccttggacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2842 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPWTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2843 - DNA, 1950 bp, Artificial Sequence
  Variant of Galactose Oxidase from Fusarium graminearum
atggcatcagcaccgatcggggtagccatcccgcgcaacaattgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtgttgatggggtaaattggggactgcctgtagcgtctgggtcctggtttgccgattccaccacaaagtactctaattttgagacaagcccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2844 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSVDGVNWGLPVASGSWFADSTTKYSNFETSPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2845 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagtagcgatgggttcggctggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2846 - protein, 650 aa, Artificial Sequence
  Variant of Galactose Oxidase from Fusarium graminearum
MASAPIGVAIPRNNWAVTCDSAQSGNECIKAIDGNLDTFWHTQYGVNGDPKPPHTITIDMKTVQNVNGLSVLPRQDGNQNGWIGRHEVYLSSDGFGWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2847 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaatctggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2848 - protein, 650 aa, Artificial Sequence
  Variant of Galactose Oxidase from Fusarium graminearum
MASAPIGVAIPRNNWAVTCDSAASGNECIKAIDGNLDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTQGQTGHHHHHH

SEQ ID NO: 2849 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggattgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaactaacaacggaggtaattcgtacagctttcaagttccgtcggacagcggggttgctcttccgggatactggatgttgttcgttatgaattccgctggtgtaccctccgttgcgtcgacgattaacgttacccgcggccaaactggccaccatcaccatcaccat

SEQ ID NO: 2850 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGLPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTRGQTGHHHHHH

SEQ ID NO: 2851 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatggcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgattggaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttagttaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2852 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDGVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDWNGNLATRPKITRTSTQSVVVGGWITIWTDMSISAASLIRYGTATHTVNTDQRRIGLTLVNNGGNSYSFQVPSDSGVALPGYWMLFVMNSAGVPSVASTINVTQGQTGHHHHHH

SEQ ID NO: 2853 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaacacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttaactaacaacggaggtaattcgtacagctttcaagttccgtcggacagcggggttgctcttccgggatactggatgttgttcgttatgaattccgctggtgtaccctccgttgcgtcgacgattaacgttacccgcggccaaactggccaccatcaccatcaccat

SEQ ID NO: 2854 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLTNNGGNSYSFQVPSDSGVALPGYWMLFVMNSAGVPSVASTINVTRGQTGHHHHHH

SEQ ID NO: 2855 - DNA, 1950 bp, Artificial Sequence
  Variant of Galactose Oxidase from Fusarium graminearum
atggcatcagcaccgatcggggtagccatcccgcgcaacaactgggccgttacatgcgattccgccgcgagtgggaatgaatgcattaaggcaattgacggtaataaggacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatggcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttacaaaacaacggaggtaattcgtacagctttcaagttccgtcggacagcggggttgctcttccgggatactggatgttgttcgttatgaattccgctggtgtaccctccgttgcgtcgacgattaacgttacccgcggccaaactggccaccatcaccatcaccat

SEQ ID NO: 2856 - protein, 650 aa, Artificial Sequence
  Variant of Galactose Oxidase from Fusarium graminearum
MASAPIGVAIPRNNWAVTCDSAASGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDGVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLQNNGGNSYSFQVPSDSGVALPGYWMLFVMNSAGVPSVASTINVTRGQTGHHHHHH

SEQ ID NO: 2857 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatcgcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaactgtcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttacaaaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2858 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDRVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQLSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLQNNGGNSYSFQVPSDSGVALPGYWMLFVMNSAGVPSVASTINVTQGQTGHHHHHH

SEQ ID NO: 2859 - DNA, 1950 bp, Artificial Sequence
  Variant of Galactose Oxidase from Fusarium graminearum
atggcatcagcaccgatcggggtagccatcccgcgcaacaactgggccgttacatgcgattccgcccagagtgggaatgaatgcattaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtaaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaatcgagccaacgagcggtcgtgtcttgatgtggagctcttatcgtcaggatgcgtttgagcgttctcctggcggtattacactgacgagctcatgggaccctagcactggaatcgtatccgatggcgtaagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagttattccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaactggtattatacatctgggtcgggggacgttaagagtgcagggaagcgtcaatcagaccgcggagtagccccagacgccatgtgcggtaatgccgtaatgtacgacgcagtcaaaggcaaaattttgactttcgggggctcgcccgattatcaagattcagatgcgactacaaatgcccatattatcacgctgggcgagcctggcacgagtccgaatacggtatttgcgagtaatgggttactgttcgctcgtacctttcatacctcggtggtccttccggacgggagtgtattcatcacaggaggccagcagcgcggagttccactggaagatagcacacccgtatttactccagagatctacgttcccgaacaagatactttttacaaacaaaacccgaatagtatcgttcgtgcgtatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgacgcatcggcttgacgttacaaaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccat

SEQ ID NO: 2860 - protein, 650 aa, Artificial Sequence
  Variant of Galactose Oxidase from Fusarium graminearum
MASAPIGVAIPRNNWAVTCDSAQSGNECIKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFERSPGGITLTSSWDPSTGIVSDGVSTVTGHDMFCPGISMDGNGQIVVSGGNDAKKTSLYDSSSDSWIPGPDMQVARGYNSSATMSDGRVFTIGGSYSGGQVEKNGEVYSPSSKTWTSLPNAKVNPMLTADKQGLYRSDNHAWLFGWKKGSVFQAGPSTAMNWYYTSGSGDVKSAGKRQSDRGVAPDAMCGNAVMYDAVKGKILTFGGSPDYQDSDATTNAHIITLGEPGTSPNTVFASNGLLFARTFHTSVVLPDGSVFITGGQQRGVPLEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIGLTLQNNGGNSYSFQVPSDSGVALPGYWMLFVMNSAGVPSVASTINVTQGQTGHHHHHH
